United States Patent 7,745,391 (HUMAN THROMBOSPONDIN POLYPEPTIDE) - sequence listing, part 141

SEQ ID NO: 372496 - DNA, 667 bp, Homo sapiens
aattcgcggccgcgtcgacgagaagacgacagaagggggccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacggctggggaaaagggccacaggatagagctcagctcccactccactcaacgccaaagctgtcctggagccagacggtcctgagctctggcactggaggcctgggagccatgcccttgaccagccttgagacctcgagcaagacaaggcaaccattctgaggctgagtttcctgctctgcaaacgacatgacaccctcggctggatgttgcagcggtgacactgaagtagtgacaccagacgatttctgtacttaatgtgatgtcagcacttagtaaacattcatatg

SEQ ID NO: 372497 - DNA, 476 bp, Homo sapiens
gaccacaactcccagggtgctccgcgtcctcgccgctgtcgccgccgcggagacaaagatggctgcgagtaagtgcaggtgccggtggcgcacggggctcgggtagttctgggaacctctgggcggtcctgggactgaggagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaaaaaaaagcggccgctcgttgtcgcgcggccgcg

SEQ ID NO: 372498 - DNA, 752 bp, Homo sapiens
gaccacaactcccagggtgctccgcgtcctcgccgctgtcgccgccgcggagacaaagatggctgcgagtaagtgcaggtgccggtggcgcacggggctcgggtagttctgggaacctctgggcggtcctgggactgaggagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaaaaaaaaaaaaaaacaaaaaaaaaaacaacggtgttgggccgcgcatctgggacctgagggagaaagtttctctgagacccttgtgcgtgtgggggggcagcgcgcccacagatgtgtctgaagtggcaccctgggccaggaggtgtgtcccagagagaaacctcgggtcaggacctgagcggctggggttttctcacccaataaaaaagcgcggggggggacacggagcgtttgggaaccaattcccaaggggaggtcgcgacaggcccttcggccttctacagaggatccaaggcaaacgaatgatgc

SEQ ID NO: 372499 - DNA, 902 bp, Homo sapiens
gaccacaactcccagggtgctccgcgtcctcgccgctgtcgccgccgcggagacaaagatggctgcgagagtcggcgccttcctcaagaatgcctgggacaaggagccagtgctggtcgtgtccttcgtcgtcgggggcctcgaacagtcccatgacactacccccaggatgctccatgatgaccctacactcaaacgtgctcattccatgaccaaccccactgctgcctcctccaggccccacgtatctctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacggctggggaaaagggccacaggatagagctcagctcccactccactcaacgccaaagctgtcctggagccagacggtcctgagctctggcactggaggcctgggagccatgcccttgaccagccttgagacctcgagcaagacaaggcaaccattctgaggctgagtttcctgctctgcaaacgacatgacaccctcggctggatgttgcagcggtgacactgaagtagtgacaccagacgatttctgtacttaatgtgatgtcagcacttagtaaacattcatatcccctgcctccagagttccttaaggttcaattgatggaatgcctcctctgcaccagcacctgggcaggtttgttgttgttgttttgcgacggaatctcacttccagcctggacaacaagagtgaaactccatctca

SEQ ID NO: 372500 - DNA, 1284 bp, Homo sapiens
  misc_feature (605)..(605): n is a, c, g, or t
cagttatcagagattctgcagtggtgcccggaccccccgttccatttttaagaattgagataattcgtatactattctgtgtttgtgcttcgtttttgttttttggggtttttttgagacagagtctcgctctgtcgccaaggctggagtgcagtggcgcgatctcagctcactgcaagctcagcctcccgagtagctgggactacaggtgcccgccaccacgacacgcaaactttttcgtatttttttagtagaggcggggtttcaccgtgttagccaggattgtctcgatctcctgaccttgtgatccactcacctcggcctcccaaagtgctgggattacaggtgtgagccaccgcgcctggcctgtgcttcgagtttctattacctttccagatttctgtctctctctgggttcccatctgtggtggtttcttggtctccatcttctcaggtttctgtcctgtttccccatctcttttgaccctagctctctagtgcgcgggatctctccctcgctatctctctggttttccgtgtctctcagtctctgtatttcccgcctctttctgcatcactgattctctgacccttccccatctcancccctggggtcccccttccctctctgaacataaagcgacagaccagctcttctctccagggccctggagacgtgctggtctcagtggcccacctcctgccccacatgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacggctggggaaaagggccacaggatagagctcagctcccactccactcaacgccaaagctgtcctggagccagacggtcctgagctctggcactggaggcctgggagccatgcccttgaccagccttgagacctcgagcaagacaaggcaaccattctgaggctgagtttcctgctctgcaaacgacatgacaccctcggctggatgttgcagcggtgacactgaagtagtgacaccagacgatttctgtacttaatgtgatgtcagcacttagtaaacattcatatcccctgcctccagagttccttaaggttcaattgatggaatgcctcctctgcaccagcacctgggcaggtttgttgttgttgttttgcgacggaatctcacttccagcctggacaacaagagtgaaactccatctca

SEQ ID NO: 372501 - DNA, 1003 bp, Homo sapiens
aattcgcggccgcgtcgacgagaagacgacagaagggggccgctgtcgccgccgcggagacaaagatggctgcgagagtcggcgccttcctcaagaatgcctgggacaaggagccagtgctggtcgtgtccttcgtcgtcgggggcctcgaacagtcccatgacactacccccaggatgctccatgatgaccctacactcaaacgtgctcattccatgaccaaccccactgctgcctcctccaggccccacgtatctctgtaattctgcccccattgagcccctacttcaagtactccgtcatgatcaacaaggccacgccctacaactacccagtagaggcggggtttcaccgtgttagccaggattgtctcgatctcctgaccttgtgatccactcacctcggcctcccaaagtgctgggattacagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacggctggggaaaagggccacaggatagagctcagctcccactccactcaacgccaaagctgtcctggagccagacggtcctgagctctggcactggaggcctgggagccatgcccttgaccagccttgagacctcgagcaagacaaggcaaccattctgaggctgagtttcctgctctgcaaacgacatgacaccctcggctggatgttgcagcggtgacactgaagtagtgacaccagacgatttctgtacttaatgtgatgtcagcacttagtaaacattcatatcccctgcctccagagttccttaaggttcaattgatggaatgcctcctctgcaccagcacctgggcaggtttgttgttgttgttttgcgacggaatctcacttccagcctggacaacaagagtgaaactccatctca

SEQ ID NO: 372502 - DNA, 1049 bp, Homo sapiens
aattcgcggccgcgtcgacgagaagacgacagaagggggccgctgtcgccgccgcggagacaaagatggctgcgagagtcggcgccttcctcaagaatgcctgggacaaggagccagtgctggtcgtgtccttcgtcgtcgggggcctcgaacagtcccatgacactacccccaggatgctccatgatgaccctacactcaaacgtgctcattccatgaccaaccccactgctgcctcctccaggccccacgtatctctgtaattctgcccccattgagcccctacttcaagtactccgtcatgatcaacaaggccacgccctacaactacccagtagaggcggggtttcaccgtgttagccaggattgtctcgatctcctgaccttgtgatccactcacctcggcctcccaaagtgctgggattacagggccctggagacgtgctggtctcagtggcccacctcctgccccacatgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacggctggggaaaagggccacaggatagagctcagctcccactccactcaacgccaaagctgtcctggagccagacggtcctgagctctggcactggaggcctgggagccatgcccttgaccagccttgagacctcgagcaagacaaggcaaccattctgaggctgagtttcctgctctgcaaacgacatgacaccctcggctggatgttgcagcggtgacactgaagtagtgacaccagacgatttctgtacttaatgtgatgtcagcacttagtaaacattcatatcccctgcctccagagttccttaaggttcaattgatggaatgcctcctctgcaccagcacctgggcaggtttgttgttgttgttttgcgacggaatctcacttccagcctggacaacaagagtgaaactccatctca

SEQ ID NO: 372503 - DNA, 644 bp, Homo sapiens
gaccacaactcccagggtgctccgcgtcctcgccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagcggctggggaaaagggccacaggatagagctcagctcccactccactcaacgccaaagctgtcctggagccagacggtcctgagctctggcactggaggcctgggagccatgcccttgaccagccttgagacctcgagcaagacaaggcaaccattctgaggctgagtttcctgctctgcaaacgacatgacaccctcggctggatgttgcagcggtgacactgaagtagtgacaccagacgatttctgtacttaatgtgatgtcagcacttagtaaacattcatatcccctgcctccagagttccttaaggttcaattgatggaatgcctcctctgcaccagcacctgggcaggtttgttgttgttgttttgcgacggaatctcacttccagcctggacaacaagagtgaaactccatctca

SEQ ID NO: 372504 - DNA, 419 bp, Homo sapiens
ctctgcaaacgacatgacaccctcggctggatgttgcagcggtgacactgaagtagtgacaccagacgatttctgtacttaatgtgatgtcagcacttagtaaacattcatatgtgagttataatttttattgataactgaagagaggggagtacagaacgctcctcctaatgacctcacctcttataaacacccccttctcttttttccccagcccctgcctccagagttccttaaggttcaattgatggaatgcctcctctgcaccagcacctgggcaggtttgttgttgttgttttgcgacggaatctcactctgtcacccaggctggagtgcagtggcgtgaatttggctcaccacaacctccacctccctggtaccagcgattctcctgcctcagcctcccgagtagctgggac

SEQ ID NO: 372505 - DNA, 412 bp, Homo sapiens
aattcgcggccgcgtcgacgagaagacgacagaagggggccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaaaaaaaagcggccgctcgttgtcgcgcggccgcg

SEQ ID NO: 372506 - DNA, 804 bp, Homo sapiens
  misc_feature (2)..(2): n is a, c, g, or t
  misc_feature (8)..(8): n is a, c, g, or t
gngcgccngaacgcggccgcgcgacacggtgcgagaagacgacagaagggggccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacgaacgtgagcatgtgtgtgatcagaggtgggaacaagtagacggtggccggggtgagtgtggggtcagtttattgggcatgcgtcagtcagaggctgggctggccagggtcgggtagggcagcagtttgtctggaccccgagaaacccaactggaatccagggcctcatctgcttcaaagccaaagtcttcctcaaccttaatctgcaggagataaggaacaaggtgttaacaggcctgggaatctagaaaatcccatcagcttcaccatttttgttttcattttgttttgctttttaaagagacagggtctcactctgttgcccaggctggagtgcagtggtgccatcatagttcactgcagcctctgcctcccaggctcaagtgatcctcccacctcagcttcccaagtagctgggac

SEQ ID NO: 372507 - DNA, 416 bp, Homo sapiens
  misc_feature (2)..(2): n is a, c, g, or t
  misc_feature (8)..(8): n is a, c, g, or t
gngcgccngaacgcggccgcgcgacacggtgcgagaagacgacagaagggggccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaaaaaaaagcggccgctcgttgtcgcgcggccgcg

SEQ ID NO: 372508 - DNA, 645 bp, Homo sapiens
aattcgcggccgcgtcgacgagaagacgacagaagggggccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaaaaaaaaaaaaaaacaaaaaaaggggggggggcgcgcccaagagagagtttccccggggggggcccacttttgcggcatccccggttttgtgtgggccaggggggcccccaaagagaggaccacccattatatacccaaaaggcgccggagcgcacagttaaacaagccctcggacaggggaaaccgcggcccaccggggaacccgtggcagagagggcaccttaaaccgcggggggagacaccaaagtggcgcaaaactctccacg

SEQ ID NO: 372509 - DNA, 971 bp, Homo sapiens
aattcgcggccgcgtcgacgagaagacgacagaagggggccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacggctggggaaaagggccacaggatagagctcagctcccactccactcaacgccaaagctgtcctggagccagacggtcctgagctctggcactggaggcctgggagccatgcccttgaccagccttgagacctcgagcaagacaaggcaaccattctgaggctgagtttcctgctctgcaaacgacatgacaccctcggctggatgttgcagcggtgacactgaagtagtgacaccagacgatttctgtacttaatgtgatgtcagcacttagtaaacattcatatcccctgcctccagagttccttaaggttcaattgatggaatgcctcctctgcaccagcacctgggcagagacggagtttcaccgtgttagccaggatggtcccgatctcctgacctcgtgatccgcctgcctcggcctcccaaagtgctgggattacaggcatgatgagccactgcgcccggcctatttcaacttaagtgaaaatctcacctgtggccagcggctaccgtgctggacagcacagtgctcatctgaggaggcaggacgcagcctctccgcctctttgcttattctgctgactgaccg

SEQ ID NO: 372510 - DNA, 795 bp, Homo sapiens
gaccacaactcccagggtgctccgcgtcctcgccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacggctggggaaaagggccacaggatagagctcagctcccactccactcaacgccaaagctgtcctggagccagacggtcctgagctctggcactggaggcctgggagccatgcccttgaccagccttgagacctcgagcaagacaaggcaaccattctgaggctgagtttcctgctctgcaaacgacatgacaccctcggctggatgttgcagcggtgacactgaagtagtgacaccagacgatttctgtacttaatgtgatgtcagcacttagtaaacattcatatcccctgcctccagagttccttaaggttcaattgatggaatgcctcctctgcaccagcacctgggcaggtttgttgttgttgttttgcgacggaatctcacttccagcctggacaacaagagtgaaactccatctca

SEQ ID NO: 372511 - DNA, 754 bp, Homo sapiens
gaccacaactcccagggtgctccgcgtcctcgccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtagaggcggggtttcaccgtgttagccaggattgtctcgatctcctgaccttgtgatccactcacctcggcctcccaaagtgctgggattacagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacggctggggaaaagggccacaggatagagctcagctcccactccactcaacgccaaagctgtcctggagccagacggtcctgagctctggcactggaggcctgggagccatgcccttgaccagccttgagacctcgagcaagacaaggcaaccattctgaggctgagtttcctgctctgcaaacgacatgacaccctcggctggatgttgcagcggtgacactgaagtagtgacaccagacgatttctgtacttaatgtgatgtcagcacttagtaaacattcatatg

SEQ ID NO: 372512 - DNA, 903 bp, Homo sapiens
  misc_feature (235)..(235): n is a, c, g, or t
  misc_feature (237)..(237): n is a, c, g, or t
  misc_feature (245)..(245): n is a, c, g, or t
aattcgcggccgcgtcgacgagaagacgacagaagggggccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcaattgggagtttccagggtaatgggctgcgctgtataatcntncctgtgtngcaggggggggggtgggggggggggggggggggggggggggtgggggggggggggggggggtgggggtggggtgtgggctaccctgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacggctggggaaaagggccacaggatagagctcagctcccactccactcaacgccaaagctgtcctggagccagacggtcctgagctctggcactggaggcctgggagccatgcccttgaccagccttgagacctcgagcaagacaaggcaaccattctgaggctgagtttcctgctctgcaaacgacatgacaccctcggctggatgttgcagcggtgacactgaagtagtgacaccagacgatttctgtacttaatgtgatgtcagcacttagtaaacattcatatcccctgcctccagagttccttaaggttcaattgatggaatgcctcctctgcaccagcacctgggcaggtttgttgttgttgttttgcgacggaatctcacttccagcctggacaacaagagtgaaactccatctca

SEQ ID NO: 372513 - DNA, 671 bp, Homo sapiens
ataaagtgttttgtagattatataattaattctcctctctctactcttctgttggtctgttgtctttataataatatatgactcataagttttaagcttatatatacaaatatatgttttataacttttagtttacagtcttggttaaaaaattgtctccatctatattttttacattcttcgagatttccataaaagctttgaaatactgcttttctaaaagaattgaagtatggcattagttgtggagttttcatcagttatatcaatttcctttatcacattgaggaaattcccttctatccctatttccactgagatgttcttgttgttgttttatcatgaatggatgttaaatgttgccagatactttttttccatctatggagataatcataaggtttttcacctttattcttttaatatggtaaattacttgtaagattttcaaatgttaaatcaaccttgaattccttagatattccttggccataatgtatcctttttatattttgctgtattttatttcctaataccctttgaaattatatgatggatattggtaggaattttatttttggaatgcctttgtcagattttggtgtgagttacctggtcttattaaatgagatattattaaattattaaaatttttgtttgcagaaataatt

SEQ ID NO: 372514 - DNA, 313 bp, Homo sapiens
gagatttgaaaagagaaaagccacagatagaaaagcaaacagggtcaggtgcggtggctcacacctgtaatcccagcattttgggaggccgaggttggtggaggtcagaagttcaagaccaacctgccaacatggcgaaaccccgtctctactaaaaatacaaaaattagccgggtgtaatggctcacgcctataatcccagccactccggattctcctgctgaggcaggagaatcgcttgaagctgggaggcagagattgcagtgagctaagatcaggccattgcactccagcctgggtgacagagcgagac

SEQ ID NO: 372515 - DNA, 1132 bp, Homo sapiens
tgttaccctggcttatggatgagctggagaggccagtgacctttgaggttctgtcctaaaagggccagagatgggctgccagcttctcccttggcagcctcccctgtcatcctgataagaacatggggtaggagggcattgagggatcaacacgctcagggctgagatttgggcaactccttccccactccctgagccccaggcaggtagaagaccctggatctttgagttgcaggagggtcttgccctaggcagcccaagctggtgtttgtggctttttttttttttttaaagctatcttgattttattttgttttgcccattactttgttttttctcgtgattttacttagtttgctcatatatggcttcatttatataacatgctagagagggcacactaaccccagaggctcatctgtggggctgagcctggggatgggcgagggtgtgtgcaaccagctcgtacaccgctgatgttaggccacgacgcggccatcgggtctagagatgagcagtgattggccaggcaagtgcgaggcccctggggccaaggctgaccactagtgagcacagagaaagccttggctaccatctgggagcagcaggcggacaggaccccaaagtctgcagccaagcccagacagggtcccttccccagatttggagccacatctcagccggggtgggcttgcctgcacccccaaggttctcctgcggtctggagtgggggtctggaaccctgggacttgccccctggagccccggggacaccagccccaggccctgggggaagcccctgtcatccccactcctgcccttggtccctcaaactccagccctgccccatcttcttcctgtacctgtcactgcagcaagttctggggagcaagacgagggtccggacagtggctggtggttattcttccccatccttggggaccagtccaagcatcccatgggcaagcctcccaggcaccccctttcaggaaccccctgcatcccacctctgcctggcactggactccaaatgacctcgtgtcctttacctcccctgcctgccagggcaagtgaggctttcagcgggaggccacctatgccacaggcatagggcatggcccacaccgaggcc

SEQ ID NO: 372516 - DNA, 520 bp, Homo sapiens
gttgattagggacattagtgaatacaaacaaatgatgtttggctatctcaggttgatattttcatatcttaaattttgtagtaggaaacaaagctgaggcagcgctgtcactgatatgcataaccaacgcataaattctctcttgaatcaggacattattcttcaacatggtagaaatacctatttcaatacatttctagttgtttgtgtttgctgtagacattggccactagagcaccactcacaataaacataccagaatgtttataaatgtgtctcaggagatcacacattttgtattttattcaaaccataaattccaaaatgctatgaacttttattcacacttcaaaaagacctgaaaaaatgatagcattgcaaaggtttttttgttttttttaagtgaggatttttttcttttcttttattgcataggtttggtatggtcacattagatgtaaaggtcttcccaaataactgataataaaagttttattgccactcttagtataccatggtt

SEQ ID NO: 372517 - DNA, 668 bp, Homo sapiens
aaacaggcaaacaaataaacagagtatcttttgagagtgataaatactataaaataaataaaacaatgaatttaaagtcagggaagcagagcatttatctgaaaggtgatgtttgagtggagatttgattgacaagaagccagccatgcaaagatctgcattaaagacaatgaaaatattaagtacgactgcaagaagtaggaataaactcagtacattagagaatagaggaaaaaggctagtggctggagtgtggagagtgatgaggggtgaggtgggtgcagtcagagaggacatagtgccagacccatgtccaagacctttgtgcttgtctataagggaagttatagtgtttggcttgaggtgaacttcaaattcctgctgtctttattcttcagctgttcccagggaagaaaccagggttctttaggccactggagcattccacaaagccctgagaaagtcttaatgattccttttgcacaactaattttcttttattgattttgtaacagtgtaccttaattttttcttattctagaacctgtacaagcttataaaatccaagatttttaatttttataacaacaaaaagaatttgtgccattttgtcttttgtcccacacttaataaaatacaatggagattgttttatgtctgtacatgta

SEQ ID NO: 372518 - DNA, 401 bp, Homo sapiens
gcctatactgagctgcagtgtaaagcaggtatggaagctgttgactgtgccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtcaaacgtacgtacatcaatcttaaatt

SEQ ID NO: 372519 - DNA, 3882 bp, Homo sapiens
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtcaaacgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtagccttcattagttaaaaacattattattttttgcatgctgcttcgactctaaatatctggttttccctgtctttttggtttactacttccccagattcagaacagaggagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacaaagacatatataccactttctagtataaatttttcaaaaaatacaataataatataatttataaagaacactcttctatgaacaaccaccaccaccaaaaaaaaaaaagccctcagaaaatttctcacaaataaggcaactaatgcctgatatctcaaaatcctttacaaaaggagatagttctagtcaaggagttttgggtatgttacttttttttcttctttttcttttcatctgcctccatcttaagtgcaatttcttcagctgtaagagctcccagtttcttattctttgctttcttaaccttttccttgatgctggccacatcaattttagtttcagtagaagctagacaaattaaaagcacaacacatgtaatactttagattttaccaagtaaaacaaagaatatatgtttaacaaagaatatatgtttaaggcagttaacttcagagtattcttataattgaataattgaaaggtgatcacagtataaaatataaaaacacttgcctaaagcagttagaaatttcttcagattaagataaaacaaatcataaaatactttatatattagtacaagtatacataaaaatggcataaatggcataattgaaccaattactggattcaactatattaagactatttccttaaatcctacttcagactaaattattttacctacattcttttccatattttggaacttctgagtcattattttccatcttgcacattaaaataatttaaaattacatgtatcccttctcaataagtttaatcagctaaccctaagctagaggtcaaaatctacttcctctaatatcaaaacgaaaatttaaagttttccaaatattaattcaatattaattgaatattcaatgaattcatttaatgttagattaattcattgaatattaattcaatgaatgactaattaatagtattttaacaagattttggtatatttaacaacattttggtaataaagacaataatttgagagtgtgtggaagtccccctaatagaagccaactatctaatcaatgccaaaagtgtgaacaaaatagagaaaggaagcagtgaaaaagaatgcaactttttcttaccattcaaagtacaggatcacagcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtatttttaaagctattaacaagcaatatattaaaataataatgtattatatctgtttctgacccagtctatgtacaatattgctggtgagccctctcccttcagtgtgtcactgttcactttggagggttactttaggaagaggataagtgttaccacaggggaaaaaaatgcagaagaggatgcatcagaagaaatggcatgacaatgttttctcttagtgtcttttaaatactaggttagtgcgaaagtgatttctgccatttaaaaaccacaatcactttcgcactaatagctcctgaataagacctgtcagcatcctttagtctaaggtgatgagaaatccatgttaccgatatagaagccaaactctaagccaagatcacataaagagaagaaaaagtacaacttctgataattcctctttgagaggcatgacagcagagctcagggatcttcttgcatttctacagaagatgcactggctgccctgggtttgtatctttcacaacaaagagtcttttccaagcacagaccagaggtcaggagaggactgtcaatccagtttgcactgaaataggcattagctgcctctaaattataaattatctcagccatcccttgtccttaggattagtaattaatgaaatgctaagagaactgatgaaaagatacaactgtttcttaaaaagattcagacaaatttattatgggtttacttttcctaattaataaagacttttacatcatagaaagcattaccttccttaggtttcacaattggtttttccttaggtggaataaatgctttgtttctttcctcttgtctcttactgatggcttctgcttgtttagcctacattaataaataaaaaatatatcagttaaatgtatttatagttaaataattcaagtatctatgaactttgctattcatgtgagccagacataaagtgccgtacctttattgcttcca

SEQ ID NO: 372520 - DNA, 3097 bp, Homo sapiens
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtcaaacgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtagccttcattagttaaaaacattattattttttgcatgctgcttcgactctaaatatctggttttccctgtctttttggtttactacttccccagattcagaacagaggagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacaaagacatatataccactttctagtataaatttttcaaaaaatacaataataatataatttataaagaacactcttctatgaacaaccaccaccaccaaaaaaaaaaaagccctcagaaaatttctcacaaataaggcaactaatgcctgatatctcaaaatcctttacaaaaggagatagttctagtcaaggagttttgggtatgttacttttttttcttctttttcttttcatctgcctccatcttaagtgcaatttcttcagctgtaagagctcccagtttcttattctttgctttcttaaccttttccttgatgctggccacatcaattttagtttcagtagaagctagacaaattaaaagcacaacacatgtaatactttagattttaccaagtaaaacaaagaatatatgtttaacaaagaatatatgtttaaggcagttaacttcagagtattcttataattgaataattgaaaggtgatcacagtataaaatataaaaacacttgcctaaagcagttagaaatttcttcagattaagataaaacaaatcataaaatactttatatattagtacaagtatacataaaaatggcataaatggcataattgaaccaattactggattcaactatattaagactatttccttaaatcctacttcagactaaattattttacctacattcttttccatattttggaacttctgagtcattattttccatcttgcacattaaaataatttaaaattacatgtatcccttctcaataagtttaatcagctaaccctaagctagaggtcaaaatctacttcctctaatatcaaaacgaaaatttaaagttttccaaatattaattcaatattaattgaatattcaatgaattcatttaatgttagattaattcattgaatattaattcaatgaatgactaattaatagtattttaacaagattttggtatatttaacaacattttggtaataaagacaataatttgagagtgtgtggaagtccccctaatagaagccaactatctaatcaatgccaaaagtgtgaacaaaatagagaaaggaagcagtgaaaaagaatgcaactttttcttaccattcaaagtacaggatcacagcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtatttttaaagctattaacaagcaatatattaaaataataatgtattatatctgtttctgacccagtctatgtacaatattgctggtgagccctctccccccggtacaaatggaaagagaaagcagctgccccactggctcatctcaggttatttactattaattaagtcacaaggatagtctaatccat

SEQ ID NO: 372521 - DNA, 3442 bp, Homo sapiens
  misc_feature (3128)..(3128): n is a, c, g, or t
  misc_feature (3131)..(3131): n is a, c, g, or t
  misc_feature (3136)..(3136): n is a, c, g, or t
  misc_feature (3138)..(3138): n is a, c, g, or t
  misc_feature (3140)..(3140): n is a, c, g, or t
  misc_feature (3143)..(3143): n is a, c, g, or t
  misc_feature (3149)..(3149): n is a, c, g, or t
  misc_feature (3152)..(3152): n is a, c, g, or t
  misc_feature (3169)..(3169): n is a, c, g, or t
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtcaaacgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtagccttcattagttaaaaacattattattttttgcatgctgcttcgactctaaatatctggttttccctgtctttttggtttactacttccccagattcagaacagaggagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacaaagacatatataccactttctagtataaatttttcaaaaaatacaataataatataatttataaagaacactcttctatgaacaaccaccaccaccaaaaaaaaaaaagccctcagaaaatttctcacaaataaggcaactaatgcctgatatctcaaaatcctttacaaaaggagatagttctagtcaaggagttttgggtatgttacttttttttcttctttttcttttcatctgcctccatcttaagtgcaatttcttcagctgtaagagctcccagtttcttattctttgctttcttaaccttttccttgatgctggccacatcaattttagtttcagtagaagctagacaaattaaaagcacaacacatgtaatactttagattttaccaagtaaaacaaagaatatatgtttaacaaagaatatatgtttaaggcagttaacttcagagtattcttataattgaataattgaaaggtgatcacagtataaaatataaaaacacttgcctaaagcagttagaaatttcttcagattaagataaaacaaatcataaaatactttatatattagtacaagtatacataaaaatggcataaatggcataattgaaccaattactggattcaactatattaagactatttccttaaatcctacttcagactaaattattttacctacattcttttccatattttggaacttctgagtcattattttccatcttgcacattaaaataatttaaaattacatgtatcccttctcaataagtttaatcagctaaccctaagctagaggtcaaaatctacttcctctaatatcaaaacgaaaatttaaagttttccaaatattaattcaatattaattgaatattcaatgaattcatttaatgttagattaattcattgaatattaattcaatgaatgactaattaatagtattttaacaagattttggtatatttaacaacattttggtaataaagacaataatttgagagtgtgtggaagtccccctaatagaagccaactatctaatcaatgccaaaagtgtgaacaaaatagagaaaggaagcagtgaaaaagaatgcaactttttcttaccattcaaagtacaggatcacagcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtatttttaaagctattaacaagcaatatattaaaataataatgtattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttttaanaanataancnanatntttttnaantttaaaaatttttttantggttctatattattattttttgggaaaattcccccttaggggggggttttaaaattaaaggggccggggtttaaaacaaggggttagtggaaaaacacccgggggtcccccacaattaaaccctttgggaaaaaatacccctttattgcaggcgtgtgtgtaataaaaaaaaggggccccacaccgtggtgcttctttcaaaaaattgtgcgcccccttataggggacaagggaaaattggcgccgacaaatatttttaaaaaaacccgcga

SEQ ID NO: 372522 - DNA, 3153 bp, Homo sapiens
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtcaaacgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtagccttcattagttaaaaacattattattttttgcatgctgcttcgactctaaatatctggttttccctgtctttttggtttactacttccccagattcagaacagaggagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacaaagacatatataccactttctagtataaatttttcaaaaaatacaataataatataatttataaagaacactcttctatgaacaaccaccaccaccaaaaaaaaaaaagccctcagaaaatttctcacaaataaggcaactaatgcctgatatctcaaaatcctttacaaaaggagatagttctagtcaaggagttttgggtatgttacttttttttcttctttttcttttcatctgcctccatcttaagtgcaatttcttcagctgtaagagctcccagtttcttattctttgctttcttaaccttttccttgatgctggccacatcaattttagtttcagtagaagctagacaaattaaaagcacaacacatgtaatactttagattttaccaagtaaaacaaagaatatatgtttaacaaagaatatatgtttaaggcagttaacttcagagtattcttataattgaataattgaaaggtgatcacagtataaaatataaaaacacttgcctaaagcagttagaaatttcttcagattaagataaaacaaatcataaaatactttatatattagtacaagtatacataaaaatggcataaatggcataattgaaccaattactggattcaactatattaagactatttccttaaatcctacttcagactaaattattttacctacattcttttccatattttggaacttctgagtcattattttccatcttgcacattaaaataatttaaaattacatgtatcccttctcaataagtttaatcagctaaccctaagctagaggtcaaaatctacttcctctaatatcaaaacgaaaatttaaagttttccaaatattaattcaatattaattgaatattcaatgaattcatttaatgttagattaattcattgaatattaattcaatgaatgactaattaatagtattttaacaagattttggtatatttaacaacattttggtaataaagacaataatttgagagtgtgtggaagtccccctaatagaagccaactatctaatcaatgccaaaagtgtgaacaaaatagagaaaggaagcagtgaaaaagaatgcaactttttcttaccattcaaagtacaggatcacagcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtatttttaaagctattaacaagcaatatattaaaataataatgtattaaaaaaaaaaaaaaaaaaaaaaaaaaaaaaaaaaaaaaaaaaaaaaaaaaaaaaaaaaaaaaaaaaaaaaaattattctaataaatcaaatttaatatcacttctctttcaaataatcttttaattcataatatttctataattaactaatataaataaacaaaaaacattgttgtcctcctttaaactagcttttttt

SEQ ID NO: 372523 - DNA, 3745 bp, Homo sapiens
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtcaaacgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtagccttcattagttaaaaacattattattttttgcatgctgcttcgactctaaatatctggttttccctgtctttttggtttactacttccccagattcagaacagaggagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacaaagacatatataccactttctagtataaatttttcaaaaaatacaataataatataatttataaagaacactcttctatgaacaaccaccaccaccaaaaaaaaaaaagccctcagaaaatttctcacaaataaggcaactaatgcctgatatctcaaaatcctttacaaaaggagatagttctagtcaaggagttttgggtatgttacttttttttcttctttttcttttcatctgcctccatcttaagtgcaatttcttcagctgtaagagctcccagtttcttattctttgctttcttaaccttttccttgatgctggccacatcaattttagtttcagtagaagctagacaaattaaaagcacaacacatgtaatactttagattttaccaagtaaaacaaagaatatatgtttaacaaagaatatatgtttaaggcagttaacttcagagtattcttataattgaataattgaaaggtgatcacagtataaaatataaaaacacttgcctaaagcagttagaaatttcttcagattaagataaaacaaatcataaaatactttatatattagtacaagtatacataaaaatggcataaatggcataattgaaccaattactggattcaactatattaagactatttccttaaatcctacttcagactaaattattttacctacattcttttccatattttggaacttctgagtcattattttccatcttgcacattaaaataatttaaaattacatgtatcccttctcaataagtttaatcagctaaccctaagctagaggtcaaaatctacttcctctaatatcaaaacgaaaatttaaagttttccaaatattaattcaatattaattgaatattcaatgaattcatttaatgttagattaattcattgaatattaattcaatgaatgactaattaatagtattttaacaagattttggtatatttaacaacattttggtaataaagacaataatttgagagtgtgtggaagtccccctaatagaagccaactatctaatcaatgccaaaagtgtgaacaaaatagagaaaggaagcagtgaaaaagaatgcaactttttcttaccattcaaagtacaggatcacagcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtatttttaaagctattaacaagcaatatattaaaataataatgtattatatctgtttctgacccagtctatgtacaatattgctggtgagccctctcccttcagtgtgtcactgttcactttggagggttactttaggaagaggataagtgttaccacaggggaaaaaaatgcagaagaggatgcatcagaagaaatggcatgacaatgttttctcttagtgtcttttaaatactaggttagtgcgaaagtgatttctgccatttaaaaaccacaatcactttcgcactaatagctcctgaataagacctgtcagcatcctttagtctaaggtgatgagaaatccatgttaccgatatagaagccaaactctaagccaagatcacataaagagaagaaaaagtacaacttctgataattcctctttgagaggcatgacagcagagctcagggatcttcttgcatttctacagaagatgcactggctgccctgggtttgtatctttcacaacaaagagtcttttccaagcacagaccagaggtcaggagaggactgtcaatccagtttgcactgaaataggcattagctgcctctaaattataaattatctcagccatcccttgtccttaggattagtaattaatgaaatgctaagagaactgatgaaaagatacaactgtttcttaaaaagattcagacaaatttattatgggtttacttttcctaattaataaagacttttacatcatagaaagcattaccttccttaggtttcacaattggtttttccttaggtggaataaatgctttgtttctttcctcttgtctcttactgatggcttctgcttgtttagcctacattaataaataaaaaatatatcagttaaatgta

SEQ ID NO: 372524 - DNA, 957 bp, Homo sapiens
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgtaaccgaaggagaacaagtccaccgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaacc

SEQ ID NO: 372525 - DNA, 838 bp, Homo sapiens
  misc_feature (789)..(789): n is a, c, g, or t
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgtaaccaacagcgagaccaagtcaaacgttactactctgttgntataccaggttggcccttatcgagggtactgagctcgattgtatcatgt

SEQ ID NO: 372526 - DNA, 960 bp, Homo sapiens
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtcaaacgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaacc

SEQ ID NO: 372527 - DNA, 3799 bp, Homo sapiens
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtcaaacgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtagccttcattagttaaaaacattattattttttgcatgctgcttcgactctaaatatctggttttccctgtctttttggtttactacttccccagattcagaacagaggagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacaaagacatatataccactttctagtataaatttttcaaaaaatacaataataatataatttataaagaacactcttctatgaacaaccaccaccaccaaaaaaaaaaaagccctcagaaaatttctcacaaataaggcaactaatgcctgatatctcaaaatcctttacaaaaggagatagttctagtcaaggagttttgggtatgttacttttttttcttctttttcttttcatctgcctccatcttaagtgcaatttcttcagctgtaagagctcccagtttcttattctttgctttcttaaccttttccttgatgctggccacatcaattttagtttcagtagaagctagacaaattaaaagcacaacacatgtaatactttagattttaccaagtaaaacaaagaatatatgtttaacaaagaatatatgtttaaggcagttaacttcagagtattcttataattgaataattgaaaggtgatcacagtataaaatataaaaacacttgcctaaagcagttagaaatttcttcagattaagataaaacaaatcataaaatactttatatattagtacaagtatacataaaaatggcataaatggcataattgaaccaattactggattcaactatattaagactatttccttaaatcctacttcagactaaattattttacctacattcttttccatattttggaacttctgagtcattattttccatcttgcacattaaaataatttaaaattacatgtatcccttctcaataagtttaatcagctaaccctaagctagaggtcaaaatctacttcctctaatatcaaaacgaaaatttaaagttttccaaatattaattcaatattaattgaatattcaatgaattcatttaatgttagattaattcattgaatattaattcaatgaatgactaattaatagtattttaacaagattttggtatatttaacaacattttggtaataaagacaataatttgagagtgtgtggaagtccccctaatagaagccaactatctaatcaatgccaaaagtgtgaacaaaatagagaaaggaagcagtgaaaaagaatgcaactttttcttaccattcaaagtacaggatcacagcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtatttttaaagctattaacaagcaatatattaaaataataatgtattatatctgtttctgacccagtctatgtacaatattgctggtgagccctctcccttcagtgtgtcactgttcactttggagggttactttaggaagaggataagtgttaccacaggggaaaaaaatgcagaagaggatgcatcagaagaaatggcatgacaatgttttctcttagtgtcttttaaatactaggttagtgcgaaagtgatttctgccatttaaaaaccacaatcactttcgcactaatagctcctgaataagacctgtcagcatcctttagtctaaggtgatgagaaatccatgttaccgatatagaagccaaactctaagccaagatcacataaagagaagaaaaagtacaacttctgataattcctctttgagaggcatgacagcagagctcagggatcttcttgcatttctacagaagatgcactggctgccctgggtttgtatctttcacaacaaagagtcttttccaagcacagaccagaggtcaggagaggactgtcaatccagtttgcactgaaataggcattagctgcctctaaattataaattatctcagccatcccttgtccttaggattagtaattaatgaaatgctaagagaactgatgaaaagatacaactgtttcttaaaaagattcagacaaatttattatgggtttacttttcctaattaataaagacttttacatcatagaaagcattaccttccttaggtttcacaattggtttttccttaggtggaataaatgctttgtttctttcctcttgtctcttactgatggcttctgcttgtttagcctacattaataaataaaaaatatatcagttaaatgta

SEQ ID NO: 372528 - DNA, 3388 bp, Homo sapiens
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtcaaacgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtagccttcattagttaaaaacattattattttttgcatgctgcttcgactctaaatatctggttttccctgtctttttggtttactacttccccagattcagaacagaggagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacaaagacatatataccactttctagtataaatttttcaaaaaatacaataataatataatttataaagaacactcttctatgaacaaccaccaccaccaaaaaaaaaaaagccctcagaaaatttctcacaaataaggcaactaatgcctgatatctcaaaatcctttacaaaaggagatagttctagtcaaggagttttgggtatgttacttttttttcttctttttcttttcatctgcctccatcttaagtgcaatttcttcagctgtaagagctcccagtttcttattctttgctttcttaaccttttccttgatgctggccacatcaattttagtttcagtagaagctagacaaattaaaagcacaacacatgtaatactttagattttaccaagtaaaacaaagaatatatgtttaacaaagaatatatgtttaaggcagttaacttcagagtattcttataattgaataattgaaaggtgatcacagtataaaatataaaaacacttgcctaaagcagttagaaatttcttcagattaagataaaacaaatcataaaatactttatatattagtacaagtatacataaaaatggcataaatggcataattgaaccaattactggattcaactatattaagactatttccttaaatcctacttcagactaaattattttacctacattcttttccatattttggaacttctgagtcattattttccatcttgcacattaaaataatttaaaattacatgtatcccttctcaataagtttaatcagctaaccctaagctagaggtcaaaatctacttcctctaatatcaaaacgaaaatttaaagttttccaaatattaattcaatattaattgaatattcaatgaattcatttaatgttagattaattcattgaatattaattcaatgaatgactaattaatagtattttaacaagattttggtatatttaacaacattttggtaataaagacaataatttgagagtgtgtggaagtccccctaatagaagccaactatctaatcaatgccaaaagtgtgaacaaaatagagaaaggaagcagtgaaaaagaatgcaactttttcttaccattcaaagtacaggatcacagcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtatttttaaagctattaacaagcaatatattaaaataataatgtattatatctgtttctgacccagtctatgtacaatattgctggtgagccctctccccccgggtataatctcttccggcttctttcactttttgtgatgttgggacggcggttccccctctctgactcctgtgcacagacacttgtttgctgccatcctcctttgcttttcgggggctcggtccctgcgtccagatggttttctgggtgactccaagaagtacatctaggtcgcagcgttttcttttgatattgaagctcacatctcgcactgggctcagtcttcaagcacgctttgttaagcacgatggatggcaaaagcaatcgcttcgccgaggacctgtgcagcttgctgccgtagtgtctgtacggctcgtagtgaagtacatatcatgtgcacaggtgatcgttccgggttagggatgcgagtgccagagtat

SEQ ID NO: 372529 - DNA, 3057 bp, Homo sapiens
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtcaaacgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtagccttcattagttaaaaacattattattttttgcatgctgcttcgactctaaatatctggttttccctgtctttttggtttactacttccccagattcagaacagaggagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacaaagacatatataccactttctagtataaatttttcaaaaaatacaataataatataatttataaagaacactcttctatgaacaaccaccaccaccaaaaaaaaaaaagccctcagaaaatttctcacaaataaggcaactaatgcctgatatctcaaaatcctttacaaaaggagatagttctagtcaaggagttttgggtatgttacttttttttcttctttttcttttcatctgcctccatcttaagtgcaatttcttcagctgtaagagctcccagtttcttattctttgctttcttaaccttttccttgatgctggccacatcaattttagtttcagtagaagctagacaaattaaaagcacaacacatgtaatactttagattttaccaagtaaaacaaagaatatatgtttaacaaagaatatatgtttaaggcagttaacttcagagtattcttataattgaataattgaaaggtgatcacagtataaaatataaaaacacttgcctaaagcagttagaaatttcttcagattaagataaaacaaatcataaaatactttatatattagtacaagtatacataaaaatggcataaatggcataattgaaccaattactggattcaactatattaagactatttccttaaatcctacttcagactaaattattttacctacattcttttccatattttggaacttctgagtcattattttccatcttgcacattaaaataatttaaaattacatgtatcccttctcaataagtttaatcagctaaccctaagctagaggtcaaaatctacttcctctaatatcaaaacgaaaatttaaagttttccaaatattaattcaatattaattgaatattcaatgaattcatttaatgttagattaattcattgaatattaattcaatgaatgactaattaatagtattttaacaagattttggtatatttaacaacattttggtaataaagacaataatttgagagtgtgtggaagtccccctaatagaagccaactatctaatcaatgccaaaagtgtgaacaaaatagagaaaggaagcagtgaaaaagaatgcaactttttcttaccattcaaagtacaggatcacagcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtatttttaaagctattaacaagcaatatattaaaataataatgtattatatctgtttctgacccagtctatgtacaatattgctggtgagccctctccctccgccccggtatcgtgcgcttactttgtagcttagagacaagttatttgg

SEQ ID NO: 372530 - DNA, 3403 bp, Homo sapiens
  misc_feature (3128)..(3128): n is a, c, g, or t
  misc_feature (3131)..(3131): n is a, c, g, or t
  misc_feature (3136)..(3136): n is a, c, g, or t
  misc_feature (3138)..(3138): n is a, c, g, or t
  misc_feature (3140)..(3140): n is a, c, g, or t
  misc_feature (3143)..(3143): n is a, c, g, or t
  misc_feature (3149)..(3149): n is a, c, g, or t
  misc_feature (3152)..(3152): n is a, c, g, or t
  misc_feature (3169)..(3169): n is a, c, g, or t
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtcaaacgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtagccttcattagttaaaaacattattattttttgcatgctgcttcgactctaaatatctggttttccctgtctttttggtttactacttccccagattcagaacagaggagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacaaagacatatataccactttctagtataaatttttcaaaaaatacaataataatataatttataaagaacactcttctatgaacaaccaccaccaccaaaaaaaaaaaagccctcagaaaatttctcacaaataaggcaactaatgcctgatatctcaaaatcctttacaaaaggagatagttctagtcaaggagttttgggtatgttacttttttttcttctttttcttttcatctgcctccatcttaagtgcaatttcttcagctgtaagagctcccagtttcttattctttgctttcttaaccttttccttgatgctggccacatcaattttagtttcagtagaagctagacaaattaaaagcacaacacatgtaatactttagattttaccaagtaaaacaaagaatatatgtttaacaaagaatatatgtttaaggcagttaacttcagagtattcttataattgaataattgaaaggtgatcacagtataaaatataaaaacacttgcctaaagcagttagaaatttcttcagattaagataaaacaaatcataaaatactttatatattagtacaagtatacataaaaatggcataaatggcataattgaaccaattactggattcaactatattaagactatttccttaaatcctacttcagactaaattattttacctacattcttttccatattttggaacttctgagtcattattttccatcttgcacattaaaataatttaaaattacatgtatcccttctcaataagtttaatcagctaaccctaagctagaggtcaaaatctacttcctctaatatcaaaacgaaaatttaaagttttccaaatattaattcaatattaattgaatattcaatgaattcatttaatgttagattaattcattgaatattaattcaatgaatgactaattaatagtattttaacaagattttggtatatttaacaacattttggtaataaagacaataatttgagagtgtgtggaagtccccctaatagaagccaactatctaatcaatgccaaaagtgtgaacaaaatagagaaaggaagcagtgaaaaagaatgcaactttttcttaccattcaaagtacaggatcacagcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtatttttaaagctattaacaagcaatatattaaaataataatgtattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttttaanaanataancnanatntttttnaantttaaaaatttttttantgggccccaatttagcgctcttttgggacataacccccatatggggcgtgttataaaattcaggggggggctttaatacacctggtggtgggaaacactcggggttcccccaattaaactcttgggaaaaaacccccttttccacgggtggggtaaaacaaaagggcccccacggggtcctttcaaaaaggtgtccccttaatgggaaagggaaattgtgggccaaattttgtt

SEQ ID NO: 372531 - DNA, 3796 bp, Homo sapiens
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgtaaccgaaggagaacaagtccaccgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtagccttcattagttaaaaacattattattttttgcatgctgcttcgactctaaatatctggttttccctgtctttttggtttactacttccccagattcagaacagaggagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacaaagacatatataccactttctagtataaatttttcaaaaaatacaataataatataatttataaagaacactcttctatgaacaaccaccaccaccaaaaaaaaaaaagccctcagaaaatttctcacaaataaggcaactaatgcctgatatctcaaaatcctttacaaaaggagatagttctagtcaaggagttttgggtatgttacttttttttcttctttttcttttcatctgcctccatcttaagtgcaatttcttcagctgtaagagctcccagtttcttattctttgctttcttaaccttttccttgatgctggccacatcaattttagtttcagtagaagctagacaaattaaaagcacaacacatgtaatactttagattttaccaagtaaaacaaagaatatatgtttaacaaagaatatatgtttaaggcagttaacttcagagtattcttataattgaataattgaaaggtgatcacagtataaaatataaaaacacttgcctaaagcagttagaaatttcttcagattaagataaaacaaatcataaaatactttatatattagtacaagtatacataaaaatggcataaatggcataattgaaccaattactggattcaactatattaagactatttccttaaatcctacttcagactaaattattttacctacattcttttccatattttggaacttctgagtcattattttccatcttgcacattaaaataatttaaaattacatgtatcccttctcaataagtttaatcagctaaccctaagctagaggtcaaaatctacttcctctaatatcaaaacgaaaatttaaagttttccaaatattaattcaatattaattgaatattcaatgaattcatttaatgttagattaattcattgaatattaattcaatgaatgactaattaatagtattttaacaagattttggtatatttaacaacattttggtaataaagacaataatttgagagtgtgtggaagtccccctaatagaagccaactatctaatcaatgccaaaagtgtgaacaaaatagagaaaggaagcagtgaaaaagaatgcaactttttcttaccattcaaagtacaggatcacagcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtatttttaaagctattaacaagcaatatattaaaataataatgtattatatctgtttctgacccagtctatgtacaatattgctggtgagccctctcccttcagtgtgtcactgttcactttggagggttactttaggaagaggataagtgttaccacaggggaaaaaaatgcagaagaggatgcatcagaagaaatggcatgacaatgttttctcttagtgtcttttaaatactaggttagtgcgaaagtgatttctgccatttaaaaaccacaatcactttcgcactaatagctcctgaataagacctgtcagcatcctttagtctaaggtgatgagaaatccatgttaccgatatagaagccaaactctaagccaagatcacataaagagaagaaaaagtacaacttctgataattcctctttgagaggcatgacagcagagctcagggatcttcttgcatttctacagaagatgcactggctgccctgggtttgtatctttcacaacaaagagtcttttccaagcacagaccagaggtcaggagaggactgtcaatccagtttgcactgaaataggcattagctgcctctaaattataaattatctcagccatcccttgtccttaggattagtaattaatgaaatgctaagagaactgatgaaaagatacaactgtttcttaaaaagattcagacaaatttattatgggtttacttttcctaattaataaagacttttacatcatagaaagcattaccttccttaggtttcacaattggtttttccttaggtggaataaatgctttgtttctttcctcttgtctcttactgatggcttctgcttgtttagcctacattaataaataaaaaatatatcagttaaatgta

SEQ ID NO: 372532 - DNA, 3547 bp, Homo sapiens
tgtctctaaatttactttttttgctgctgacaaagtactgagttgctcagacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtcaaacgttactactctgttgtatatccaggctggcccatatatccacgtaacagatacacttctctctttctcattgttaattcagtaattctaatactgtctgttataattaccattttggtacagcacaagtaccctaatttagttcttttggactaatacaattcaggaaagaaaaaacccaaaaaccaacctcattcacatatggctttttttttaaccaataacaattaggtgtacttctattttaaaacatttcagaaaaaaatatatgttatagcaatactcttactcaaaagaagaaatttcctaactctatcagataaactcatctttagtataaataagcattatttgcaggttgccacaggtggacttttagtaagtaacctaacccatgtttcagcttctaaatctgcaaaatgagcaaggtacagtagcacatttttaggtgattcttagtaactccagtagccttcattagttaaaaacattattattttttgcatgctgcttcgactctaaatatctggttttccctgtctttttggtttactacttccccagattcagaacagaggagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggatttaatggataatcacaatggtcgtaatgtatacaaagacatatataccactttctagtataaatttttcaaaaaatacaataataatataatttataaagaacactcttctatgaacaaccaccaccaccaaaaaaaaaaaagccctcagaaaatttctcacaaataaggcaactaatgcctgatatctcaaaatcctttacaaaaggagatagttctagtcaaggagttttgggtatgttacttttttttcttctttttcttttcatctgcctccatcttaagtgcaatttcttcagctgtaagagctcccagtttcttattctttgctttcttaaccttttccttgatgctggccacatcaattttagtttcagtagaagctagacaaattaaaagcacaacacatgtaatactttagattttaccaagtaaaacaaagaatatatgtttaacaaagaatatatgtttaaggcagttaacttcagagtattcttataattgaataattgaaaggtgatcacagtataaaatataaaaacacttgcctaaagcagttagaaatttcttcagattaagataaaacaaatcataaaatactttatatattagtacaagtatacataaaaatggcataaatggcataattgaaccaattactggattcaactatattaagactatttccttaaatcctacttcagactaaattattttacctacattcttttccatattttggaacttctgagtcattattttccatcttgcacattaaaataatttaaaattacatgtatcccttctcaataagtttaatcagctaaccctaagctagaggtcaaaatctacttcctctaatatcaaaacgaaaatttaaagttttccaaatattaattcaatattaattgaatattcaatgaattcatttaatgttagattaattcattgaatattaattcaatgaatgactaattaatagtattttaacaagattttggtatatttaacaacattttggtaataaagacaataatttgagagtgtgtggaagtccccctaatagaagccaactatctaatcaatgccaaaagtgtgaacaaaatagagaaaggaagcagtgaaaaagaatgcaactttttcttaccattcaaagtacaggatcacagcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtatttttaaagctattaacaagcaatatattaaaataataatgtattatatctgtttctgacccagtctatgtacaatattgctggtgagccctctcccttcagtgtgtcactgttcactttggagggttactttaggaagaggataagtgttaccacaggggaaaaaaatgcagaagaggatgcatcagaagaaatggcatgacaatgttttctcttagtgtcttttaaatactaggttagtgcgaaagtgatttctgccatttaaaaaccacaatcactttcgcactaatagctcctgaataagacctgtcagcatcctttagtctaaggtgatgagaaatccatgttaccgatatagaagccaaactctaagccaagatcacataaagagaagaaaaagtacaacttctgataattcctctttgagaggcatgacagcagagctcagggatcttcttgcatttctacagaagatgcactggctgccctgggtttgtatctttcacaacaaagagtcttttccaagcacagaccagaggtcaggagaggactgtcaatccagtttgcactgaaataggcattagctgcctctaaattataaattatctcagccatcccttgtccttaggattagtaattaatgaaatgctaagagaactgatgaaaagatacaactgtttcttaaaaagattcagacaaatttattatgggtttacttttcctaattaataaagacttttacatcatagaaagcattaccttccttaggtttcacaattggtttttccttaggtggaataaatgctttgtttctttcctcttgtctcttactgatggcttctgcttgtttagcctacattaataaataaaaaatatatcagttaaatgta

SEQ ID NO: 372533 - DNA, 477 bp, Homo sapiens
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgatgggacgaagactggcgcagtcttcttccatcaggaaagcagtgctgatgataaggaccc

SEQ ID NO: 372534 - DNA, 481 bp, Homo sapiens
agattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaa

SEQ ID NO: 372535 - DNA, 589 bp, Homo sapiens
  misc_feature (19)..(19): n is a, c, g, or t
  misc_feature (36)..(36): n is a, c, g, or t
  misc_feature (42)..(42): n is a, c, g, or t
  misc_feature (208)..(208): n is a, c, g, or t
aaggcgacaggcttaagcnccatgcccactaaggtncgtctnacattatagattgtaaaattccaggtcacggctacatacatctaatatggtgattcattttctcctcaagaagctgtttttaaatcaatggttcatcttacagtcaactgtgtcttagattcaaatatggcccatggatttgcaggcagtcacttgacctcgtgcngaattcgggcacgaggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaa

SEQ ID NO: 372536 - DNA, 741 bp, Homo sapiens
  misc_feature (553)..(553): n is a, c, g, or t
  misc_feature (557)..(557): n is a, c, g, or t
agattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaaaaaaaaaaaaaaaaaaaaaaaaaaaaattttgtgggggcttgggccctcggaaaaagttttttagaacattntgtntgggggggcgggggcccatgtttgggtaagtgaacaagtgggcacataagggtgttccaaagggaaactgtgggccatggaaataggggtgggggtttctccgcatttaaaagacgggccgggggggaaacgagaggtgttttgaacaatttccaaaggggagtttcaggaggggaataacggg

SEQ ID NO: 372537 - DNA, 859 bp, Homo sapiens
  misc_feature (571)..(571): n is a, c, g, or t
  misc_feature (672)..(672): n is a, c, g, or t
agattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanccctttttggcccccttggcccaattgatttttaatttgaacaagttttttgtttgggcccaaatttgggcctctttggccaattcccccttatggggggngtattaaaattcactggcccgtgtgttaaaaccgtgggaatggaaaaaacctgggggtacccaactttaatcgtttggaaaaaatcccttttgccaggttggtaattacgaaaaggcccgacccgagacgcctttcaaaagttggccaccctgaagggaaatgaaaattggaccgttatttttgtta

SEQ ID NO: 372538 - DNA, 798 bp, Homo sapiens
agattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaaaaaaaaaaaaaaaaatttttggggggcttgggcctgaaaaatttttaaaacatttggtggggccgcgggggcgcccaagagggaacagtggagcaccagtggggccacacagctgtgtctcccccgaaggaaagacccctggcgtccacggaccagcggcgtgtcggagtttccttccccacagttaaaaagaagccgccggggggcggcaaccaagacccgtgtttctggaacaaattcccaaatggcggcgcccggaggggcacaacggggatccaaccaacgggggtgtccaaggagaagccgcgaatatccag

SEQ ID NO: 372539 - DNA, 806 bp, Homo sapiens
agattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaaatgcatttcttttttttaaatatgttacacaaaatcgaaaaaaaaaaaaaaaaaaaaaaaaaaaattttgttgcggggccgcttggggcccgaaagaaagttgtttaacaccacttcgggggggccggcgcgcagaaggtaatgcgaaccctgggccaaggtggctcccaagaaaacccggggcaggaacaggtggctggtttcccaccaaaaaaaacgcgggggaaccgagtggtggaccaatccgaggctcagcgccaccgctctacacagggcaaggagtgaaatacacgcggcggcagagagaacaccaacaacgcgacac

SEQ ID NO: 372540 - DNA, 566 bp, Homo sapiens
agattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaactcacccccaccacaacatacccccttaccaacatgcggccgcaatttgagcttacttggccaattccccctatagggagtcgaa

SEQ ID NO: 372541 - DNA, 536 bp, Homo sapiens
agattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaagatcctgttgtctcctagctctactatctcgtgatctaacctctggtcgttttct

SEQ ID NO: 372542 - DNA, 178 bp, Homo sapiens
tcacattctcctttttaaactgtttttcagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaa

SEQ ID NO: 372543 - DNA, 835 bp, Homo sapiens
agattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatataaaaatttagtctatatcaacaaatacctaacttcatatatcacatattcttctatattgcaacaagctttattatctattatcttctctctaaatatatatctctcatatcaatatatatcacattttttcttaatcctcgtatacatcgcaataacctctgtatctctaacataatctactatatggatataccttactccagtatttgtatatttact

SEQ ID NO: 372544 - DNA, 774 bp, Homo sapiens
agattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaatactatctaaattattttatatttataattatattttataataaatattcaattataaataattaattaatttcaatttttataacattaccattcttcatttatatcattttcatttattaactataacttataatatttatataatctctcatactatattaattattt

SEQ ID NO: 372545 - DNA, 720 bp, Homo sapiens
agattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaaaaaaaaaaaaaaaaaaaaaaaaaaaaacatacaaaaaaaaaaaaaccacaaaaaacctcgggtttttttttttttttttttgggatggcaaaaattttttaaaatgggagaccctgttttaatctttttgtgccatgaaactccttaaggcagcctacaaagaccatggggaggttgaggatcatttgaccccaaaagtttgaggttgtataaagcttctgaatgcttgcttgttgggg

SEQ ID NO: 372546 - DNA, 902 bp, Homo sapiens
  misc_feature (483)..(483): n is a, c, g, or t
  misc_feature (491)..(491): n is a, c, g, or t
agattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaacnaccacacncaccacaccaaacacaaccacacccccacccacacacaccacacccgcaacacaccacgaacaagccaccacaacacagaaagcagacacaacaaaacacaacacacacacgcgcgggccgcgccgcgcccacaacaacaacacaacacgcgggggggacgagacaaagtatagagacgagcgcagcaatacgaggcgccaacgcaccgctacagaagacagagggctgctcacacaaaaaacagcgggcgggaggagctgcaacaacaaatgacggcgtcggggccagcgaacaaacgaggccgcagataacccccgccgccgggaaacaaggagaaccagaacgaaggacgagcacgagaaaaaaacaacagacaagagaggagcagacaacagaacgaaacagacacg

SEQ ID NO: 372547 - DNA, 532 bp, Homo sapiens
tcacattctcctttttaaactgtttttcagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatataaaaatttagtctatatcaacaaatacctaacttcatatatcacatattcttctatattgcaacaagctttattatctattatcttctctctaaatatatatctctcatatcaatatatatcacattttttcttaatcctcgtatacatcgcaataacctctgtatctctaacataatctactatatggatataccttactccagtatttgtatatttact

SEQ ID NO: 372548 - DNA, 428 bp, Homo sapiens
gaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggtaagccggcttcggcccgggggccgactccacgggctgatttccgaaaagggtggtgggcagggagaccgtcagcctgcgaaccctctctccgaggtcggccctctacttgcttccggttgcctagaagccgaggcttgcgaaacgaagcccgatagaaactacatcctgctctagtgaaaaacagcgtttctgggtgtatcagagtgggccttagggcagagtagcgacgcgggggccgggaaggtagattagaaaag

SEQ ID NO: 372549 - DNA, 367 bp, Homo sapiens
ctcgtgccgaattcggcacgagcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaa

SEQ ID NO: 372550 - DNA, 400 bp, Homo sapiens
agattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagatgtggttcgagattctccccggactctccgtcatgggcgtgtgcttgttgattccacggacctggctactgcgtacatccacagcttcacttcgtggcagcggtacc

SEQ ID NO: 372551 - DNA, 562 bp, Homo sapiens
gcggccgcctactactactaaattcgcggccgctcgacgaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 372552 - DNA, 410 bp, Homo sapiens
gcggccgcctactactactaaattcgcggccgctcgacgagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 372553 - DNA, 1475 bp, Homo sapiens
ctgggattacaggcgtgagccaccatgcccagccctgcatttaaaaaacaaaacaaaacaaaaaaaacttttttcttgtggtgagctatagcttatatacaaaagtgtgcacaaaacctacatgtacagttcaaagaataattataaagtgagcccccatatgacaaccaccctgagttaagaaggagagcattgccaggcagtgccttaccagcctccctggtctcccaacccagtcatggtcccttccctctcttagaggtaactcttctaaggtaaaagcttgtgatcatcattcccttgcttttctgtagtaacttttccacctatatgtccatcccttggcaatatgagtttagcccatttgtgaatttcctacaaatggacttgcgttttcccagctctggtctgtctgcttcttccacattctctttgagatccgtccatgttgacgtgtgtaggggtaggcagtccatttttattgcagctggagccttctttataaagcctgcttcttctgctgatccacatcctttagagtgcctagcacagggctgaaaatgcagcagctgctctgtaaagacctgttgattagattggggggaggaaatccccgagaacgtgcgaggctgctgtcgagagctagcagaaagtgctctgccaggcctggtggccccccaggcattctacttttgtctttctctcctctggatctggctgttgcatttctgtcgtggacaatctgagatgtttccatctccctgtaaaattaattcccatttctgtgtcccttttcagaatgccgaactggggaggaggcaagaaatgtggggtgtgtcagaagacggtttactttgccgaagaggttcagtgcgaaggcaacagcttccataaatcctgcttcctgtgcagtgagtacgccccaggccctattgctgttgccttggacaccctggacgggcctgcccccacaggctgggcctgtcaacaccccagggaactgatcccatgggatgtaaacagcttgacatttggctgaagcgcagctgggcagggaaacacttcagggcctctttgttccgttcagaagcttctttctaagggatgaactggccagagcgggtcggggtggcaggcgttcaggggctgaaagccaagctgtaaagacttggttaagaaaactttccactcagctctctcttctctctctccctgtcatgatttcaccatttcagaggaaaacactttcagccctttgcaccctaattatctcttgttcaaaggcaacagaggccacaacctcatggtgaagctgaatctggaggaagagtggggctcctccttcctcagccccttgcaggctggcctgttcagttcttcacttcccattcccactcagcctgggatgagaggaagagggagtacaaagttccctgatatctactcctaagaagccagagcaaggtttgctccag

SEQ ID NO: 372554 - DNA, 468 bp, Homo sapiens
  misc_feature (460)..(460): n is a, c, g, or t
gcccagccagtggggtaacagctactttggtgttaaacccaccccctcacctgccttttgtggtatagctggtgaccctaatcatcaggccattgcaacatagcatggaagatggtgcgaggtggcgtgtggtccctggccttctccctctactgccttgcaccataggccatgtcctcccagcagcaccagctgagtagacttcagaagtggcttgagcccttataccatggttatgtcaaagggagtgggcctggggtggagggtaccctcatcactggtggcagccattaactatttccttccctgcctagtcctggcataaggcctgctttcgatgtgccaagtgtggcaaaggccttgagtcaaccaccctggcagacaaggatggcgagatttactgcaaaggtgggtgttttcacttctaattgagggtcaggaggccaataaaaagttcagngttcaaaa

SEQ ID NO: 372555 - DNA, 1956 bp, Homo sapiens
ggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 372556 - DNA, 1832 bp, Homo sapiens
gcggccgctccaacatcagaatggtaacagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 372557 - DNA, 2872 bp, Homo sapiens
  misc_feature (2865)..(2865): n is a, c, g, or t
ggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaaaaaaaaaaaaaaaaaaaaaaaaaaaaaaaaaaaaaaaaaaaaaaaaaaaaaagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaacacaccctgcccactcctgcgcttttcatcgccattccattcccagcagctttggagacctccaggattatttctctgtcagcctgcacatatatcactaatgacttgaacttgggcatctggctccctttggtttgggggtctgaggtcacccataaggtccagctggattgaacatacagagaaccatgtttggtcagtaganagccccc

SEQ ID NO: 372558 - DNA, 2294 bp, Homo sapiens
ggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaaaaaaaaaaaaaaaaaaaaaaaaaaaaaaaaaaaaaaaaaaaaaaaaaaaaaaggggggggggcccaaaaaaaataccccgaggggggcacaagcgaggccgacaacgacacttaacaaacaaggaggggccccaatagagggaggacgaataataacgacgcacacacggagcgccccgagattaaacaagccgacgaccgggtggggaaacaaaaccgaaacggaagcaaactatggaaaggagacacacccaacgggcggagggagcacaatagaggaaacaaaccgaagagaagagaaaagacacgggaggaaaaaaaaacaagcgccaagggcg

SEQ ID NO: 372559 - DNA, 1828 bp, Homo sapiens
  misc_feature (29)..(29): n is a, c, g, or t
  misc_feature (31)..(33): n is a, c, g, or t
cggacgcgtgggtcgacccacgcgtcggncnnncgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 372560 - DNA, 2113 bp, Homo sapiens
  misc_feature (2029)..(2030): n is a, c, g, or t
ggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaaaaaaaaaaaaaaagcactcaattgggcaattaacattagtgtttgttctctgatggtatctctgagaatactnnttgtaggactggccagtagtgcttcgggactgggttcacccccaggtctgcggcagttgtcacagcgccagccccgctggcct

SEQ ID NO: 372561 - DNA, 2564 bp, Homo sapiens
ctgggattacaggcgtgagccaccatgcccagccctgcatttaaaaaacaaaacaaaacaaaaaaaacttttttcttgtggtgagctatagcttatatacaaaagtgtgcacaaaacctacatgtacagttcaaagaataattataaagtgagcccccatatgacaaccaccctgagttaagaaggagagcattgccaggcagtgccttaccagcctccctggtctcccaacccagtcatggtcccttccctctcttagaggtaactcttctaaggtaaaagcttgtgatcatcattcccttgcttttctgtagtaacttttccacctatatgtccatcccttggcaatatgagtttagcccatttgtgaatttcctacaaatggacttgcgttttcccagctctggtctgtctgcttcttccacattctctttgagatccgtccatgttgacgtgtgtaggggtaggcagtccatttttattgcagctggagccttctttataaagcctgcttcttctgctgatccacatcctttagagtgcctagcacagggctgaaaatgcagcagctgctctgtaaagacctgttgattagattggggggaggaaatccccgagaacgtgcgaggctgctgtcgagagctagcagaaagtgctctgccaggcctggtggccccccaggcattctacttttgtctttctctcctctggatctggctgttgcatttctgtcgtggacaatctgagatgtttccatctccctgtaaaattaattcccatttctgtgtcccttttcagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 372562 - DNA, 1533 bp, Homo sapiens
tctgccagggtggttgactcaaggcctttgccacacttggcacatcgaaagcaggccttatgccaggacttcccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 372563 - DNA, 1608 bp, Homo sapiens
acggcggaaaacacgatattgtactaacatcttaatttgttataaaatctcacaaaccccctgacatagtctcagagatctgtagggccgaggttacatttggagaacccgtactctagggccaaatccattcttcttgccctggatcacttgtcccccccagcgccccgcgctggagccactgcctagttcttcagccctagatggtgctcgccaagacaagaaccacacgtgtgggttcttgtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 372564 - DNA, 1668 bp, Homo sapiens
gcccagccagtggggtaacagctactttggtgttaaacccaccccctcacctgccttttgtggtatagctggtgaccctaatcatcaggccattgcaacatagcatggaagatggtgcgaggtggcgtgtggtccctggccttctccctctactgccttgcaccataggccatgtcctcccagcagcaccagctgagtagacttcagaagtggcttgagcccttataccatggttatgtcaaagggagtgggcctggggtggagggtaccctcatcactggtggcagccattaactatttccttccctgcctagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 372565 - DNA, 1551 bp, Homo sapiens
  misc_feature (1548)..(1548): n is a, c, g, or t
ggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccagagatcaatgaagatttgagccattgataaatgccaatatatgtttcaggtatttcattaggatcctcccatcaagcagggaactagatgtttagaagatcaaacaacagggtnccg

SEQ ID NO: 372566 - DNA, 974 bp, Homo sapiens
  misc_feature (2)..(2): n is a, c, g, or t
cngagtgggtctgctccaaacacctttccctttgccctgagacctcagaatcttccctttaacccaagaccctgcctcttccactccacccttctgcagggacccattcatgatatcgatctcgaattggtaggcatggtgttaggtagtagcgtggggaagaaggggaaagggctgggcctcaccgctcccagcaactgaaaggacaacactagctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 372567 - DNA, 661 bp, Homo sapiens
gcggccgcctactactactaaattcgcggccgctcgacggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 372568 - DNA, 1338 bp, Homo sapiens
  misc_feature (1)..(2): n is a, c, g, or t
  misc_feature (14)..(14): n is a, c, g, or t
  misc_feature (42)..(43): n is a, c, g, or t
  misc_feature (1331)..(1331): n is a, c, g, or t
nnccctgggctctngtaaagaatagtgcctctggtgaacccnnggcaagaaagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaaaaaaaaaaaaaaaaaaaaaaaaaaaaaaaaaaaaaaaaaaaaaaaaaaaaaagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaacacaccctgcccactcctgcgcttttcatcgccattccattcccagcagctttggagacctccaggattatttctctgtcagcctgcacatatatcactaatgacttgaacttgggcatctggctccctttggtttgggggtctgaggtcacccataaggtccagctggattgaacatacagagaaccatgtttggtcagtaganagccccc

SEQ ID NO: 372569 - DNA, 1050 bp, Homo sapiens
  misc_feature (1028)..(1028): n is a, c, g, or t
ggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagaagaatattatcgttgagcgtccaaatcataggacgaactgggcatggtcctggatggggtgctaggcaccacagggtccggctgtatgcacactgaaccggttggaatacagcgccccataccaagtatcattggtcactcaacgactcacgccggggaaggggtctcttgcatccgtcgnctatcaacacgcgagtaggcgg

SEQ ID NO: 372570 - DNA, 760 bp, Homo sapiens
  misc_feature (698)..(698): n is a, c, g, or t
  misc_feature (746)..(746): n is a, c, g, or t
ggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggnatgctgaatgcctaaaaaaactctcggggccccaagggggcttttggntttttggggccaag

SEQ ID NO: 372571 - DNA, 857 bp, Homo sapiens
gcggccgctccaacatcagaatggtaacagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggagtgagtaaaagatcccctcccaacctttttcttgagctctctcccccaccctgtattaggcctcatgtgtatttacaaccatttttgggtaagcaatggaaggctcagaaaaccagttatttaaaaggcagtcacagagcagtgtctatgtgtcaggctgctgcaggagctggggatgcagcagggactaaaacaggctgggctcctccctgcaaggagcgtgcattctatatttgtatgagagtcagagctgggaggggccccaagaatcacttagtccaatttcctctttttttgtttttttttgaaagggagtcttgctctgtcacccaggctggagtgcagtggtacaatcttggctcactgcagcctctgcttcttgggctcaagtgatcctcttgcctcaggctcccgagtagctgggagtacaggcatgtgccaccacacccagctaattctgtattttgtagagacagggtttcaccatgttgcctcctctttttatagat

SEQ ID NO: 372572 - DNA, 1146 bp, Homo sapiens
ctgggattacaggcgtgagccaccatgcccagccctgcatttaaaaaacaaaacaaaacaaaaaaaacttttttcttgtggtgagctatagcttatatacaaaagtgtgcacaaaacctacatgtacagttcaaagaataattataaagtgagcccccatatgacaaccaccctgagttaagaaggagagcattgccaggcagtgccttaccagcctccctggtctcccaacccagtcatggtcccttccctctcttagaggtaactcttctaaggtaaaagcttgtgatcatcattcccttgcttttctgtagtaacttttccacctatatgtccatcccttggcaatatgagtttagcccatttgtgaatttcctacaaatggacttgcgttttcccagctctggtctgtctgcttcttccacattctctttgagatccgtccatgttgacgtgtgtaggggtaggcagtccatttttattgcagctggagccttctttataaagcctgcttcttctgctgatccacatcctttagagtgcctagcacagggctgaaaatgcagcagctgctctgtaaagacctgttgattagattggggggaggaaatccccgagaacgtgcgaggctgctgtcgagagctagcagaaagtgctctgccaggcctggtggccccccaggcattctacttttgtctttctctcctctggatctggctgttgcatttctgtcgtggacaatctgagatgtttccatctccctgtaaaattaattcccatttctgtgtcccttttcagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcatgaaaggacaacactatctggagccacccactgaaagggctgcaggcatgggctgtacccaagctgatttctcatctggtcaataaagctgtttagaccagaa

SEQ ID NO: 372573 - DNA, 743 bp, Homo sapiens
gcggccgctccaacatcagaatggtaacagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcagtgagtacgccccaggccctattgctgttgccttggacaccctggacgggcctgcccccacaggctgggcctgtcaacaccccagggaactgatcccatgggatgtaaacagcttgacatttggctgaagcgcagctgggcagggaaacacttcagggcctctttgttccgttcagaagcttctttctaagggatgaactggccagagcgggtcggggtggcaggcgttcaggggctgaaagccaagctgtaaagacttggttaagaaaactttccactcagctctctcttctctctctccctgtcatgatttcaccatttcagaggaaaacactttcagccctttgcaccctaattatctcttgttcaaaggcaacagaggccacaacctcatggtgaagctgaatctggaggaagagtggggctcctccttcctcagccccttgcaggctggcctgttcagttcttcacttcccattcccactcagcctgggatgagaggaagagggagtacaaagttccctgatatctactcctaagaagccagagcaaggtttgctccag

SEQ ID NO: 372574 - DNA, 753 bp, Homo sapiens
gtaagaagcttgcaatgagcaagaaggtcaccccagcttcaactcaatgcgtccgcttccccttcccctccacagtggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggagtgagtaaaagatcccctcccaacctttttcttgagctctctcccccaccctgtattaggcctcatgtgtatttacaaccatttttgggtaagcaatggaaggctcagaaaaccagttatttaaaaggcagtcacagagcagtgtctatgtgtcaggctgctgcaggagctggggatgcagcagggactaaaacaggctgggctcctccctgcaaggagcgtgcattctatatttgtatgagagtcagagctgggaggggccccaagaatcacttagtccaatttcctctttttttgtttttttttgaaagggagtcttgctctgtcacccaggctggagtgcagtggtacaatcttggctcactgcagcctctgcttcttgggctcaagtgatcctcttgcctcaggctcccgagtagctgggagtacaggcatgtgccaccacacccagctaattctgtattttgtagagacagggtttcaccatgttgcctcctctttttatagat

SEQ ID NO: 372575 - DNA, 2215 bp, Homo sapiens
ggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaaaaaaaccacacagcaccaccacacaaacaaaaaccggagggggggccggtaaccaattgggctataggaggcggattacatacatggcgccgttaaaagccggacgggaaaccggggtacccattatcgtggaggatcccctagcacggcgaaacgaaggcgcaaagctcccagaggccccaaggaggaaggacggattggacacgcacaggcctataccacgacggccgcacgcgggtgccccagcaatgccgagact

SEQ ID NO: 372576 - DNA, 2041 bp, Homo sapiens
ggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaaaaaaaaaaaaaaaaaaaaaaaaaaaaaaaaaaaaaaaaaaaaaaaaaaaaaaggggggggcccaaaattcccccggggggcccca

SEQ ID NO: 372577 - DNA, 1988 bp, Homo sapiens
ggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaaaaaaacggcacgaggagacgtcgagaggtcgg

SEQ ID NO: 372578 - DNA, 2021 bp, Homo sapiens
ggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaaaaaaaaaaaaaaaaaaaaaaaaaaaaaaaaaaggggggggcccaaaattcccccggggggcccca

SEQ ID NO: 372579 - DNA, 1201 bp, Homo sapiens
ctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 372580 - DNA, 908 bp, Homo sapiens
  misc_feature (29)..(29): n is a, c, g, or t
  misc_feature (31)..(33): n is a, c, g, or t
cggacgcgtgggtcgacccacgcgtcggncnnncgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 372581 - DNA, 922 bp, Homo sapiens
  misc_feature (29)..(29): n is a, c, g, or t
  misc_feature (31)..(33): n is a, c, g, or t
  misc_feature (900)..(900): n is a, c, g, or t
cggacgcgtgggtcgacccacgcgtcggncnnncgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagaagaatattatcgttgagcgtccaaatcataggacgaactgggcatggtcctggatggggtgctaggcaccacagggtccggctgtatgcacactgaaccggttggaatacagcgccccataccaagtatcattggtcactcaacgactcacgccggggaaggggtctcttgcatccgtcgnctatcaacacgcgagtaggcgg

SEQ ID NO: 372582 - DNA, 1284 bp, Homo sapiens
  misc_feature (1217)..(1218): n is a, c, g, or t
  misc_feature (1222)..(1222): n is a, c, g, or t
  misc_feature (1279)..(1279): n is a, c, g, or t
ctgggattacaggcgtgagccaccatgcccagccctgcatttaaaaaacaaaacaaaacaaaaaaaacttttttcttgtggtgagctatagcttatatacaaaagtgtgcacaaaacctacatgtacagttcaaagaataattataaagtgagcccccatatgacaaccaccctgagttaagaaggagagcattgccaggcagtgccttaccagcctccctggtctcccaacccagtcatggtcccttccctctcttagaggtaactcttctaaggtaaaagcttgtgatcatcattcccttgcttttctgtagtaacttttccacctatatgtccatcccttggcaatatgagtttagcccatttgtgaatttcctacaaatggacttgcgttttcccagctctggtctgtctgcttcttccacattctctttgagatccgtccatgttgacgtgtgtaggggtaggcagtccatttttattgcagctggagccttctttataaagcctgcttcttctgctgatccacatcctttagagtgcctagcacagggctgaaaatgcagcagctgctctgtaaagacctgttgattagattggggggaggaaatccccgagaacgtgcgaggctgctgtcgagagctagcagaaagtgctctgccaggcctggtggccccccaggcattctacttttgtctttctctcctctggatctggctgttgcatttctgtcgtggacaatctgagatgtttccatctccctgtaaaattaattcccatttctgtgtcccttttcagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtctggcnnaagnctgctttcgagtgccagtgtggcaagctggtcacactggcgacaggtggcggtttangcaag

SEQ ID NO: 372583 - DNA, 1206 bp, Homo sapiens
ctgggattacaggcgtgagccaccatgcccagccctgcatttaaaaaacaaaacaaaacaaaaaaaacttttttcttgtggtgagctatagcttatatacaaaagtgtgcacaaaacctacatgtacagttcaaagaataattataaagtgagcccccatatgacaaccaccctgagttaagaaggagagcattgccaggcagtgccttaccagcctccctggtctcccaacccagtcatggtcccttccctctcttagaggtaactcttctaaggtaaaagcttgtgatcatcattcccttgcttttctgtagtaacttttccacctatatgtccatcccttggcaatatgagtttagcccatttgtgaatttcctacaaatggacttgcgttttcccagctctggtctgtctgcttcttccacattctctttgagatccgtccatgttgacgtgtgtaggggtaggcagtccatttttattgcagctggagccttctttataaagcctgcttcttctgctgatccacatcctttagagtgcctagcacagggctgaaaatgcagcagctgctctgtaaagacctgttgattagattggggggaggaaatccccgagaacgtgcgaggctgctgtcgagagctagcagaaagtgctctgccaggcctggtggccccccaggcattctacttttgtctttctctcctctggatctggctgttgcatttctgtcgtggacaatctgagatgtttccatctccctgtaaaattaattcccatttctgtgtcccttttcagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaatcaccttctccgcagcatagactgcctggctgcatcgggggcagcgctgagccaccaatcttctggggaaatttgatgcattgggaccgagctcgatga

SEQ ID NO: 372584 - DNA, 554 bp, Homo sapiens
ttttaaagtaattatcaatttattatcaaccgtatcttatctgaaagtggatttaatgctatacatagagctcagacttggtaataaaactgtttgcctttgctcagcagtgtttgtgaataacctatgtttttctgcaggtcagacatggctgtgatgccacatgctggggtccgggacctggtgggtgccttcagacgctcctgcacagagccattgatgaaaacaacgagcccaccgcctgctttcttattcgcaggtctgagagtccccagtatctctccacagctttttagtgagcttgttgcaaactggctctttcctttttaaatccgtctatagtcttggcatgccagtagccggcttgactttcacagttaaggttatcagagagtcactgttctgtcatgtcaagtcagccaggagccaggctcacttgtgacgggaggagctcacagccctgaatcaaagaatctgaaagctggagtcagcgtcctgctttgggagctgcctgagctcctgtagtcacggcagaccagttcagactgtgaagc

SEQ ID NO: 372585 - DNA, 556 bp, Homo sapiens
gggaccgggcctcccccctgtgttgcagatatgctgtccaaggagcctccgtggtgtgacggctcctactgctatgagtgcactgccaggttcggagtcaccactcgcaaacaccactgtggtaagaccccagcgtcactggcaaggagcgaggggactgccgctgatgtcattgcttccccccttctccaggacaggccgtgaacttgcctgggtcctgcacattgatgggcaaaccttgaccaaatggagggatgagatgagcacacccaaggatcctactgaggaacagagatgtagggaaggcagggagcctgcagacgggtggctttcctgctggaggctgaaggtgcacagtttccaggcagcctgccaggcctgtgccatccttcctgacttcctgcctgcaccaaagctgagatgagctactgccctcatggtgtgcctcagtatgggccgctttgccgagaactaaggggctgttcccattaaaatgagattacaggcgtgagccaccatgcctggcctgagctgctcttgatcttccaaaaaaaaa

SEQ ID NO: 372586 - DNA, 7480 bp, Homo sapiens
agtgccgggccagacatggcggaagaggaggtggccaagttggagaagcacttgatgcttctgcggcaggagtatgtcaagctgcagaagaagctggcggagacagagaagcgctgcgctctcttggctgcgcaggcaaacaaggagagcagcagcgagtccttcatcagccgtctgctggccatcgtggcagacctctacgagcaggagcagtacagcgatctgaagataaaggttggggacaggcacatcagtgctcacaagtttgtcctggcagcccgcagtgacagctggagtctggctaacttgtcttccactaaagagttggacctgtcagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggacgacctgaggaaggaggatttcagcagcatgagcgctcagttgttatacaaaatgatcaaatccaagacagagtacccgctacataaagccatcaaagtggagagagaagacgtggtcttcctgtatctgattgaaatggattcccagctccctgggaagctgaatgaagcggatcataacggagatctggcattagatctagccctctcacgacgactggagagtattgccaccacgctggttagtcacaaagctgatgtggacatggtggacaagagtggctggagcttgttacacaaaggaatccaaagaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggactcctttacatgtgtccatcatggccgggaatgaatatgtgttcagtcagctgctgcagtgcaaacaactagatttagaactcaaagaccacgagggcagcacggctctgtggctggcagtgcagcatatcacagtgtcttctgaccagtctgtgaaccccttcgaagatgtccccgtggtaaatgggacttcatttgatgagaacagctttgcagccagactcatccagcgcggcagccacacagacgcacctgacacggcgacaggaaactgtttactacagcgggcagctggagcaggaaacgaggcagcagctcttttcctggcaaccaacggtgcccatgtcaaccacagaaacaagtggggagaaaccccgttgcacacagcgtgtcggcatggcctggccaacctcacagcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctgctgggctctggagccgccatcaatgacaccatgtcggatgggcagacgctactgcacatggccatacagcggcaggacagcaagagcgcactcttcctgctggagcaccaggcagatataaatgtcaggactcaggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgagacagacaagggctgaccccgtttgcctgtgccatgactttcaagaacaacaagtcagccgaggccattctcaaacgagagtccggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgtcgtcactgcggacgtcttctttgccataaatgctcgaccaaggagattcctattataaagtttgatctgaacaagcctgtgcgggtttgcaacatttgttttgatgtactgactctgggtggggtttcttagtgagccccccggagggtccaggccacgtccttggtcacctccccagcagctgctctgctcaccagcctgaccccacccagagcaggagctggcgggtgtcttcctgcggcaatagactggaacgattaaggaccatggtgtgatagatcccatttcaaatgattccatatgattgtcagtgtgtgtgtcagactgtgatcgatttcactagatgtctcactcatcagaccaggccattgggcctaagtggtaaatgtgattaggaattagacctctccccattctgctagcaacatacagggacacttggaaaaccatttccccttccagtagcttggtgtccatcccagagcattcatgaagtcttcccgcctgggctgactgatgaggcagagcctctcagcgtaggaagctggctgcttaatgagctggctttactctagggtaagtggctgtggacttttctgcacagtgttttcataaagataataggatcctcttgccctgaagtctttttttctttttacgctaagctgtatttttagtgagctaccccttttaaaaaggtgaaatctttcttaacagggttcaaagatgagagctgaaaaatcgtggccttaacaactgaaagctttacagtgttcatgctactgaggtgtcaggagtgcagctgggccgcttgacacctcgtagcagccgtctcattctctcgtcttgctgcgtcctgtctgtggagtcctcagtcactctgctgttggagagtgctggaggaaatgcacttttactgtgctgcactttttatagagctgcattgtcggtgattccaatttaaaaatccatattcaaaaataccctcacacatccctgcatcagtgattctaatgatcagctttgactggacctcagctcacacgaatctccaaggaaaaactctacagagcatcttttagagcaagagattcatacaggccaagtgatgagagggggagtcaccaaggcttcagccccaagggcatctccagcctcaggccggcaggtcctatgtccttgacacaaacgcttcttgctgaaatcctccctagtgatgctgcgagtgctgttggtcccagttctgtgtagcttgccctgccccatgaagggccaccagccaagggccctggccacgtgtgcgccaccttactttggaagtctctggcttgtgtgctggatgaggctgccagaacttgttgggcgttcatcgctgttagtacatatattaaccgtgaggtgttaaacttttcttttgaaggtttggccagtttctaaaaaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagtgtgtcctctgtattgcggtagatttatacattctgttgcctaaatatgtgtgtaaaatgagctgataaactggagtactacttaaaaaaaagtctgtgatttataagatgtatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttggccatgtgaggcatgtggtcagtttccattttctattacctggaaagggccataaggaagcaggcagggcttaggtagcttggttacctaagttagaaagtaagagaatcatggttcggatatgaattgaagtggttggtacatggatacctgttctttaaaaggaatgtgggagatgagtcaagggtgaggccgattgttctgcccatgccctaccataccaatttcaataacaatcttgcctgtcattgcactcagaatcttaagatcatgtttcaaatatgttgattcaaacttgcttctaagcctgagtccagggatagcaatggtactgaccagctatggactgggagaacattgagtcctgttttccattggcttcagggcgcatccatgtggatataggaaaagcctctttccacagacttaggaagccccccgaccacgcggacgctcgctgggctgcactcagcaggctgcttgagtgggagctgactccaacatgccctgccctggctgggactaggcatgcttccagcccttcccgtgctctccctgctgtcaacacttgcgtacaaacctgcctagctgttgtaagttttcatcagtagcttaagtactagtagcaaaaacttaaattcattcagaaagttgccacttctgaatgagtagagcaggaaaagtaaactttactgaaacataatttgctgcaacagtcaacattgttatgctgaatgtgctctcaactgccctttgctcatcgccagatttattatccagtgtattcctaacagtcttttgttgtcgttgtttttaaaacaaaggtacggaccatgtgctatatataaatcgaatggcttaaactaatttgctatgatcctctaacaccgaaatttcccataaacttaagtgcctacacttaggacttttgaactttcagtcatctttttcgtggtgtctcactgaacgatgtgttagaacatgtgttccatttggagttttgggcctgtgcacggtcaaccccaattaccaatttagttgaggctggattcgattgctcagttcacctgccacgttctctccaaggagtggggtctacgtgacctttagtcctctacctcagagccccgagtcatttctgaccaccccgttctgtgtcctcactcttgtccctgaatgggtccctgtgtggatctcagtgtgtgtgtggtttctccactcctccccgctcatgtcccacacctgccatattgaaccgtttctgcactaatcttctccacgggcacggagtggagggaacgtcttgggaaaggggagagcttgacctccatctaggtttcttttatctggagaaaaagaacacttttgaactatgtaatgcttcgccctgaaaggcaagctaacgctaacttcccaggtgacagtagcaggaacaaggaagggtaatgtttccatgacagacacttgcttcccttgggacaagtcccagaagaactacctgaagcaccaaagctccccaccccagcctggtggcagaggaagcaggtggcaccaactcaccaaagggacttgggagccaccttctcactctgtggaagtactttagtgagagctgactggcaagataaaaaccctgaaattcccagaagttacagatgccttaaagactttctttggaagatcattgcctgtactattccttttttgtgtggcataaataatatattaacctgttacaactgacaacattggttttctgcagctagggagtcttgagtcgagactgctcgccttgatgacttgctcttttttggcagatgtgtggagttggctgttacgacatccctgtgtgatcccagaggaggggcagtagctgggcagaaactgcaggcacacatttgggtggatcacctggcttccagccccttcggggtggtgctcagtgtggggtgatggtatcatagaggaccacggcgcttatcagcattgtttctttggagtctgtgtaatggaatgtatttttcaaatactgatatttgcattttctgtaacaattccttataataaaatgaagtaaaattgtgcatttaaagtggaaactttaataagacatttgtagttacttctaatgcagaagtaccaataagcattaaaaacaaattttaga

SEQ ID NO: 372587 - DNA, 7411 bp, Homo sapiens
agtgccgggccagacatggcggaagaggaggtggccaagttggagaagcacttgatgcttctgcggcaggagtatgtcaagctgcagaagaagctggcggagacagagaagcgctgcgctctcttggctgcgcaggcaaacaaggagagcagcagcgagtccttcatcagccgtctgctggccatcgtggcagacctctacgagcaggagcagtacagcgatctgaagataaaggttggggacaggcacatcagtgctcacaagtttgtcctggcagcccgcagtgacagctggagtctggctaacttgtcttccactaaagagttggacctgtcagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggacgacctgaggaaggaggatttcagcagcatgagcgctcagttgttatacaaaatgatcaaatccaagacagagtacccgctacataaagccatcaaagtggagagagaagacgtggtcttcctgtatctgattgaaatggattcccagctccctgggaagctgaatgaagcggatcataacggagatctggcattagatctagccctctcacgacgactggagagtattgccaccacgctggttagtcacaaagctgatgtggacatggtggacaagagtggctggagcttgttacacaaaggaatccaaagaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggactcctttacatgtgtccatcatggccgggaatgaatatgtgttcagtcagctgctgcagtgcaaacaactagatttagaactcaaagaccacgagggcagcacggctctgtggctggcagtgcagcatatcacagtgtcttctgaccagtctgtgaaccccttcgaagatgtccccgtggtaaatgggacttcatttgatgagaacagctttgcagccagactcatccagcgcggcagccacacagacgcacctgacacggcgacaggaaactgtttactacagcgggcagctggagcaggaaacgaggcagcagctcttttcctggcaaccaacggtgcccatgtcaaccacagaaacaagtggggagaaaccccgttgcacacagcgtgtcggcatggcctggccaacctcacagcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctgctgggctctggagccgccatcaatgacaccatgtcggatgggcagacgctactgcacatggccatacagcggcaggacagcaagagcgcactcttcctgctggagcaccaggcagatataaatgtcaggactcaggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgagacagacaagggctgaccccgtttgcctgtgccatgactttcaagaacaacaagtcagccgaggccattctcaaacgagagtccggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgtcgtcactgcggacgtcttctttgccataaatgctcgaccaaggagattcctattataaagtttgatctgaacaagcctgtgcgggtttgcaacatttgttttgatgtactgactctgggtggggtttcttagtgagccccccggagggtccaggccacgtccttggtcacctccccagcagctgctctgctcaccagcctgaccccacccagagcaggagctggcgggtgtcttcctgcggcaatagactggaacgattaaggaccatggtgtgatagatcccatttcaaatgattccatatgattgtcagtgtgtgtgtcagactgtgatcgatttcactagatgtctcactcatcagaccaggccattgggcctaagtggtaaatgtgattaggaattagacctctccccattctgctagcaacatacagggacacttggaaaaccatttccccttccagtagcttggtgtccatcccagagcattcatgaagtcttcccgcctgggctgactgatgaggcagagcctctcagcgtaggaagctggctgcttaatgagctggctttactctagggtaagtggctgtggacttttctgcacagtgttttcataaagataataggatcctcttgccctgaagtctttttttctttttacgctaagctgtatttttagtgagctaccccttttaaaaaggtgaaatctttcttaacagggttcaaagatgagagctgaaaaatcgtggccttaacaactgaaagctttacagtgttcatgctactgaggtgtcaggagtgcagctgggccgcttgacacctcgtagcagccgtctcattctctcgtcttgctgcgtcctgtctgtggagtcctcagtcactctgctgttggagagtgctggaggaaatgcacttttactgtgctgcactttttatagagctgcattgtcggtgattccaatttaaaaatccatattcaaaaataccctcacacatccctgcatcagtgattctaatgatcagctttgactggacctcagctcacacgaatctccaaggaaaaactctacagagcatcttttagagcaagagattcatacaggccaagtgatgagagggggagtcaccaaggcttcagccccaagggcatctccagcctcaggccggcaggtcctatgtccttgacacaaacgcttcttgctgaaatcctccctagtgatgctgcgagtgctgttggtcccagttctgtgtagcttgccctgccccatgaagggccaccagccaagggccctggccacgtgtgcgccaccttactttggaagtctctggcttgtgtgctggatgaggctgccagaacttgttgggcgttcatcgctgttagtacatatattaaccgtgaggtgttaaacttttcttttgaaggtttggccagtttctaaaaaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagtgtgtcctctgtattgcggtagatttatacattctgttgcctaaatatgtgtgtaaaatgagctgataaactggagtactacttaaaaaaaagtctgtgatttataagatgtatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttggccatgtgaggcatgtggtcagtttccattttctattacctggaaagggccataaggaagcaggcagggcttaggtagcttggttacctaagttagaaagtaagagaatcatggttcggatatgaattgaagtggttggtacatggatacctgttctttaaaaggaatgtgggagatgagtcaagggtgaggccgattgttctgcccatgccctaccataccaatttcaataacaatcttgcctgtcattgcactcagaatcttaagatcatgtttcaaatatgttgattcaaacttgcttctaagcctgagtccagggatagcaatggtactgaccagctatggactgggagaacattgagtcctgttttccattggcttcagggcgcatccatgtggatataggaaaagcctctttccacagacttaggaagccccccgaccacgcggacgctcgctgggctgcactcagcaggctgcttgagtgggagctgactccaacatgccctgccctggctgggactaggcatgcttccagcccttcccgtgctctccctgctgtcaacacttgcgtacaaacctgcctagctgttgtaagttttcatcagtagcttaagtactagtagcaaaaacttaaattcattcagaaagttgccacttctgaatgagtagagcaggaaaagtaaactttactgaaacataatttgctgcaacagtcaacattgttatgctgaatgtgctctcaactgccctttgctcatcgccagatttattatccagtgtattcctaacagtcttttgttgtcgttgtttttaaaacaaaggtacggaccatgtgctatatataaatcgaatggcttaaactaatttgctatgatcctctaacaccgaaatttcccataaacttaagtgcctacacttaggacttttgaactttcagtcatctttttcgtggtgtctcactgaacgatgtgttagaacatgtgttccatttggagttttgggcctgtgcacggtcaaccccaattaccaatttagttgaggctggattcgattgctcagttcacctgccacgttctctccaaggagtggggtctacgtgacctttagtcctctacctcagagccccgagtcatttctgaccaccccgttctgtgtcctcactcttgtccctgaatgggtccctgtgtggatctcagtgtgtgtgtggtttctccactcctccccgctcatgtcccacacctgccatattgaaccgtttctgcactaatcttctccacgggcacggagtggagggaacgtcttgggaaaggggagagcttgacctccatctaggtttcttttatctggagaaaaagaacacttttgaactatgtaatgcttcgccctgaaaggcaagctaacgctaacttcccaggtgacagtagcaggaacaaggaagggtaatgtttccatgacagacacttgcttcccttgggacaagtcccagaagaactacctgaagcaccaaagctccccaccccagcctggtggcagaggaagcaggtggcaccaactcaccaaagggacttgggagccaccttctcactctgtggaagtactttagtgagagctgactggcaagataaaaaccctgaaattcccagaagttacagatgccttaaagactttctttggaagatcattgcctgtactattccttttttgtgtggcataaataatatattaacctgttacaactgacaacattgtgtggagttggctgttacgacatccctgtgtgatcccagaggaggggcagtagctgggcagaaactgcaggcacacatttgggtggatcacctggcttccagccccttcggggtggtgctcagtgtggggtgatggtatcatagaggaccacggcgcttatcagcattgtttctttggagtctgtgtaatggaatgtatttttcaaatactgatatttgcattttctgtaacaattccttataataaaatgaagtaaaattgtgcatttaaagtggaaactttaataagacatttgtagttacttctaatgcagaagtaccaataagcattaaaaacaaattttaga

SEQ ID NO: 372588 - DNA, 6248 bp, Homo sapiens
agtgccgggccagacatggcggaagaggaggtggccaagttggagaagcacttgatgcttctgcggcaggagtatgtcaagctgcagaagaagctggcggagacagagaagcgctgcgctctcttggctgcgcaggcaaacaaggagagcagcagcgagtccttcatcagccgtctgctggccatcgtggcagacctctacgagcaggagcagtacagcgatctgaagataaaggttggggacaggcacatcagtgctcacaagtttgtcctggcagcccgcagtgacagctggagtctggctaacttgtcttccactaaagagttggacctgtcagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggacgacctgaggaaggaggatttcagcagcatgagcgctcagttgttatacaaaatgatcaaatccaagacagagtacccgctacataaagccatcaaagtggagagagaagacgtggtcttcctgtatctgattgaaatggattcccagctccctgggaagctgaatgaagcggatcataacggagatctggcattagatctagccctctcacgacgactggagagtattgccaccacgctggttagtcacaaagctgatgtggacatggtggacaagagtggctggagcttgttacacaaaggaatccaaagaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggactcctttacatgtgtccatcatggccgggaatgaatatgtgttcagtcagctgctgcagtgcaaacaactagatttagaactcaaagaccacgagggcagcacggctctgtggctggcagtgcagcatatcacagtgtcttctgaccagtctgtgaaccccttcgaagatgtccccgtggtaaatgggacttcatttgatgagaacagctttgcagccagactcatccagcgcggcagccacacagacgcacctgacacggcgacaggaaactgtttactacagcgggcagctggagcaggaaacgaggcagcagctcttttcctggcaaccaacggtgcccatgtcaaccacagaaacaagtggggagaaaccccgttgcacacagcgtgtcggcatggcctggccaacctcacagcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctgctgggctctggagccgccatcaatgacaccatgtcggatgggcagacgctactgcacatggccatacagcggcaggacagcaagagcgcactcttcctgctggagcaccaggcagatataaatgtcaggactcaggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgagacagacaagggctgaccccgtttgcctgtgccatgactttcaagaacaacaagtcagccgaggccattctcaaacgagagtccggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgtcgtcactgcggacgtcttctttgccataaatgctcgaccaaggagattcctattataaagtttgatctgaacaagcctgtgcgggtttgcaacatttgttttgatgtactgactctgggtggggtttcttagtgagccccccggagggtccaggccacgtccttggtcacctccccagcagctgctctgctcaccagcctgaccccacccagagcaggagctggcgggtgtcttcctgcggcaatagactggaacgattaaggaccatggtgtgatagatcccatttcaaatgattccatatgattgtcagtgtgtgtgtcagactgtgatcgatttcactagatgtctcactcatcagaccaggccattgggcctaagtggtaaatgtgattaggaattagacctctccccattctgctagcaacatacagggacacttggaaaaccatttccccttccagtagcttggtgtccatcccagagcattcatgaagtcttcccgcctgggctgactgatgaggcagagcctctcagcgtaggaagctggctgcttaatgagctggctttactctagggtaagtggctgtggacttttctgcacagtgttttcataaagataataggatcctcttgccctgaagtctttttttctttttacgctaagctgtatttttagtgagctaccccttttaaaaaggtgaaatctttcttaacagggttcaaagatgagagctgaaaaatcgtggccttaacaactgaaagctttacagtgttcatgctactgaggtgtcaggagtgcagctgggccgcttgacacctcgtagcagccgtctcattctctcgtcttgctgcgtcctgtctgtggagtcctcagtcactctgctgttggagagtgctggaggaaatgcacttttactgtgctgcactttttatagagctgcattgtcggtgattccaatttaaaaatccatattcaaaaataccctcacacatccctgcatcagtgattctaatgatcagctttgactggacctcagctcacacgaatctccaaggaaaaactctacagagcatcttttagagcaagagattcatacaggccaagtgatgagagggggagtcaccaaggcttcagccccaagggcatctccagcctcaggccggcaggtcctatgtccttgacacaaacgcttcttgctgaaatcctccctagtgatgctgcgagtgctgttggtcccagttctgtgtagcttgccctgccccatgaagggccaccagccaagggccctggccacgtgtgcgccaccttactttggaagtctctggcttgtgtgctggatgaggctgccagaacttgttgggcgttcatcgctgttagtacatatattaaccgtgaggtgttaaacttttcttttgaaggtttggccagtttctaaaaaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagtgtgtcctctgtattgcggtagatttatacattctgttgcctaaatatgtgtgtaaaatgagctgataaactggagtactacttaaaaaaaagtctgtgatttataagatgtatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttggccatgtgaggcatgtggtcagtttccattttctattacctggaaagggccataaggaagcaggcagggcttaggtagcttggttacctaagttagaaagtaagagaatcatggttcggatatgaattgaagtggttggtacatggatacctgttctttaaaaggaatgtgggagatgagtcaagggtgaggccgattgttctgcccatgccctaccataccaatttcaataacaatcttgcctgtcattgcactcagaatcttaagatcatgtttcaaatatgttgattcaaacttgcttctaagcctgagtccagggatagcaatggtactgaccagctatggactgggagaacattgagtcctgttttccattggcttcagggcgcatccatgtggatataggaaaagcctctttccacagacttaggaagccccccgaccacgcggacgctcgctgggctgcactcagcaggctgcttgagtgggagctgactccaacatgccctgccctggctgggactaggcatgcttccagcccttcccgtgctctccctgctgtcaacacttgcgtacaaacctgcctagctgttgtaagttttcatcagtagcttaagtactagtagcaaaaacttaaattcattcagaaagttgccacttctgaatgagtagagcaggaaaagtaaactttactgaaacataatttgtcagtgtggggtgatggtatcatagaggaccacggcgcttatcagcattgtttctttggagtctgtgtaatggaatgtatttttcaaatactgatatttgcattttctgtaacaattccttataataaaatgaagtaaaattgtgcatttaaagtggaaactttaataagacatttgtagttacttctaatgcagaagtaccaataagcattaaaaacaaattttaga

SEQ ID NO: 372589 - DNA, 6159 bp, Homo sapiens
gattagagcaaccatcaactaggcgtctccagattaaccatcaactaggagtctccagattagagcagccatcaactaggagtctccagtatagagcaaccatcaactaggagtcggattcctgtctctgagggataaggaaaaacatggaaactgtttactacagcgggcagctggagcaggaaacgaggcagcagctcttttcctggcaaccaacggtgcccatgtcaaccacagaaacaagtggggagaaaccccgttgcacacagcgtgtcggcatggcctggccaacctcacagcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctgctgggctctggagccgccatcaatgacaccatgtcggatgggcagacgctactgcacatggccatacagcggcaggacagcaagagcgcactcttcctgctggagcaccaggcagatataaatgtcaggactcaggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgagacagacaagggctgaccccgtttgcctgtgccatgactttcaagaacaacaagtcagccgaggccattctcaaacgagagtccggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgtcgtcactgcggacgtcttctttgccataaatgctcgaccaaggagattcctattataaagtttgatctgaacaagcctgtgcgggtttgcaacatttgttttgatgtactgactctgggtggggtttcttagtgagccccccggagggtccaggccacgtccttggtcacctccccagcagctgctctgctcaccagcctgaccccacccagagcaggagctggcgggtgtcttcctgcggcaatagactggaacgattaaggaccatggtgtgatagatcccatttcaaatgattccatatgattgtcagtgtgtgtgtcagactgtgatcgatttcactagatgtctcactcatcagaccaggccattgggcctaagtggtaaatgtgattaggaattagacctctccccattctgctagcaacatacagggacacttggaaaaccatttccccttccagtagcttggtgtccatcccagagcattcatgaagtcttcccgcctgggctgactgatgaggcagagcctctcagcgtaggaagctggctgcttaatgagctggctttactctagggtaagtggctgtggacttttctgcacagtgttttcataaagataataggatcctcttgccctgaagtctttttttctttttacgctaagctgtatttttagtgagctaccccttttaaaaaggtgaaatctttcttaacagggttcaaagatgagagctgaaaaatcgtggccttaacaactgaaagctttacagtgttcatgctactgaggtgtcaggagtgcagctgggccgcttgacacctcgtagcagccgtctcattctctcgtcttgctgcgtcctgtctgtggagtcctcagtcactctgctgttggagagtgctggaggaaatgcacttttactgtgctgcactttttatagagctgcattgtcggtgattccaatttaaaaatccatattcaaaaataccctcacacatccctgcatcagtgattctaatgatcagctttgactggacctcagctcacacgaatctccaaggaaaaactctacagagcatcttttagagcaagagattcatacaggccaagtgatgagagggggagtcaccaaggcttcagccccaagggcatctccagcctcaggccggcaggtcctatgtccttgacacaaacgcttcttgctgaaatcctccctagtgatgctgcgagtgctgttggtcccagttctgtgtagcttgccctgccccatgaagggccaccagccaagggccctggccacgtgtgcgccaccttactttggaagtctctggcttgtgtgctggatgaggctgccagaacttgttgggcgttcatcgctgttagtacatatattaaccgtgaggtgttaaacttttcttttgaaggtttggccagtttctaaaaaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagtgtgtcctctgtattgcggtagatttatacattctgttgcctaaatatgtgtgtaaaatgagctgataaactggagtactacttaaaaaaaagtctgtgatttataagatgtatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttggccatgtgaggcatgtggtcagtttccattttctattacctggaaagggccataaggaagcaggcagggcttaggtagcttggttacctaagttagaaagtaagagaatcatggttcggatatgaattgaagtggttggtacatggatacctgttctttaaaaggaatgtgggagatgagtcaagggtgaggccgattgttctgcccatgccctaccataccaatttcaataacaatcttgcctgtcattgcactcagaatcttaagatcatgtttcaaatatgttgattcaaacttgcttctaagcctgagtccagggatagcaatggtactgaccagctatggactgggagaacattgagtcctgttttccattggcttcagggcgcatccatgtggatataggaaaagcctctttccacagacttaggaagccccccgaccacgcggacgctcgctgggctgcactcagcaggctgcttgagtgggagctgactccaacatgccctgccctggctgggactaggcatgcttccagcccttcccgtgctctccctgctgtcaacacttgcgtacaaacctgcctagctgttgtaagttttcatcagtagcttaagtactagtagcaaaaacttaaattcattcagaaagttgccacttctgaatgagtagagcaggaaaagtaaactttactgaaacataatttgctgcaacagtcaacattgttatgctgaatgtgctctcaactgccctttgctcatcgccagatttattatccagtgtattcctaacagtcttttgttgtcgttgtttttaaaacaaaggtacggaccatgtgctatatataaatcgaatggcttaaactaatttgctatgatcctctaacaccgaaatttcccataaacttaagtgcctacacttaggacttttgaactttcagtcatctttttcgtggtgtctcactgaacgatgtgttagaacatgtgttccatttggagttttgggcctgtgcacggtcaaccccaattaccaatttagttgaggctggattcgattgctcagttcacctgccacgttctctccaaggagtggggtctacgtgacctttagtcctctacctcagagccccgagtcatttctgaccaccccgttctgtgtcctcactcttgtccctgaatgggtccctgtgtggatctcagtgtgtgtgtggtttctccactcctccccgctcatgtcccacacctgccatattgaaccgtttctgcactaatcttctccacgggcacggagtggagggaacgtcttgggaaaggggagagcttgacctccatctaggtttcttttatctggagaaaaagaacacttttgaactatgtaatgcttcgccctgaaaggcaagctaacgctaacttcccaggtgacagtagcaggaacaaggaagggtaatgtttccatgacagacacttgcttcccttgggacaagtcccagaagaactacctgaagcaccaaagctccccaccccagcctggtggcagaggaagcaggtggcaccaactcaccaaagggacttgggagccaccttctcactctgtggaagtactttagtgagagctgactggcaagataaaaaccctgaaattcccagaagttacagatgccttaaagactttctttggaagatcattgcctgtactattccttttttgtgtggcataaataatatattaacctgttacaactgacaacattggttttctgcagctagggagtcttgagtcgagactgctcgccttgatgacttgctcttttttggcagatgtgtggagttggctgttacgacatccctgtgtgatcccagaggaggggcagtagctgggcagaaactgcaggcacacatttgggtggatcacctggcttccagccccttcggggtggtgctcagtgtggggtgatggtatcatagaggaccacggcgcttatcagcattgtttctttggagtctgtgtaatggaatgtatttttcaaatactgatatttgcattttctgtaacaattccttataataaaatgaagtaaaattgtg

SEQ ID NO: 372590 - DNA, 4113 bp, Homo sapiens
cattgcgggcgccttggctgccaggccctgctgcggttgtcctcacgtgccaggaagcagagtctgtcgttggcgctcctctcatacttcctttctttgcttccacagtcgtcactgcggacgtcttctttgccataaatgctcgaccaaggagattcctattataaagtttgatctgaacaagcctgtgcgggtttgcaacatttgttttgatgtactgactctgggtggggtttcttagtgagccccccggagggtccaggccacgtccttggtcacctccccagcagctgctctgctcaccagcctgaccccacccagagcaggagctggcgggtgtcttcctgcggcaatagactggaacgattaaggaccatggtgtgatagatcccatttcaaatgattccatatgattgtcagtgtgtgtgtcagactgtgatcgatttcactagatgtctcactcatcagaccaggccattgggcctaagtggtaaatgtgattaggaattagacctctccccattctgctagcaacatacagggacacttggaaaaccatttccccttccagtagcttggtgtccatcccagagcattcatgaagtcttcccgcctgggctgactgatgaggcagagcctctcagcgtaggaagctggctgcttaatgagctggctttactctagggtaagtggctgtggacttttctgcacagtgttttcataaagataataggatcctcttgccctgaagtctttttttctttttacgctaagctgtatttttagtgagctaccccttttaaaaaggtgaaatctttcttaacagggttcaaagatgagagctgaaaaatcgtggccttaacaactgaaagctttacagtgttcatgctactgaggtgtcaggagtgcagctgggccgcttgacacctcgtagcagccgtctcattctctcgtcttgctgcgtcctgtctgtggagtcctcagtcactctgctgttggagagtgctggaggaaatgcacttttactgtgctgcactttttatagagctgcattgtcggtgattccaatttaaaaatccatattcaaaaataccctcacacatccctgcatcagtgattctaatgatcagctttgactggacctcagctcacacgaatctccaaggaaaaactctacagagcatcttttagagcaagagattcatacaggccaagtgatgagagggggagtcaccaaggcttcagccccaagggcatctccagcctcaggccggcaggtcctatgtccttgacacaaacgcttcttgctgaaatcctccctagtgatgctgcgagtgctgttggtcccagttctgtgtagcttgccctgccccatgaagggccaccagccaagggccctggccacgtgtgcgccaccttactttggaagtctctggcttgtgtgctggatgaggctgccagaacttgttgggcgttcatcgctgttagtacatatattaaccgtgaggtgttaaacttttcttttgaaggtttggccagtttctaaaaaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagtgtgtcctctgtattgcggtagatttatacattctgttgcctaaatatgtgtgtaaaatgagctgataaactggagtactacttaaaaaaaagtctgtgatttataagatgtatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttggccatgtgaggcatgtggtcagtttccattttctattacctggaaagggccataaggaagcaggcagggcttaggtagcttggttacctaagttagaaagtaagagaatcatggttcggatatgaattgaagtggttggtacatggatacctgttctttaaaaggaatgtgggagatgagtcaagggtgaggccgattgttctgcccatgccctaccataccaatttcaataacaatcttgcctgtcattgcactcagaatcttaagatcatgtttcaaatatgttgattcaaacttgcttctaagcctgagtccagggatagcaatggtactgaccagctatggactgggagaacattgagtcctgttttccattggcttcagggcgcatccatgtggatataggaaaagcctctttccacagacttaggaagccccccgaccacgcggacgctcgctgggctgcactcagcaggctgcttgagtgggagctgactccaacatgccctgccctggctgggactaggcatgcttccagcccttcccgtgctctccctgctgtcaacacttgcgtacaaacctgcctagctgttgtaagttttcatcagtagcttaagtactagtagcaaaaacttaaattcattcagaaagttgccacttctgaatgagtagagcaggaaaagtaaactttactgaaacataatttgctgcaacagtcaacattgttatgctgaatgtgctctcaactgccctttgctcatcgccagatttattatccagtgtattcctaacagtcttttgttgtcgttgtttttaaaacaaaggtacggaccatgtgctatatataaatcgaatggcttaaactaatttgctatgatcctctaacaccgaaatttcccataaacttaagtgcctacacttaggacttttgaactttcagtcatctttttcgtggtgtctcactgaacgatgtgttagaacatgtgttccatttggagttttgggcctgtgcacggtcaaccccaattaccaatttagttgaggctggattcgattgctcagttcacctgccacgttctctccaaggagtggggtctacgtgacctttagtcctctacctcagagccccgagtcatttctgaccaccccgttctgtgtcctcactcttgtccctgaatgggtccctgtgtggatctcagtgtgtgtgtggtttctccactcctccccgctcatgtcccacacctgccatattgaaccgtttctgcactaatcttctccacgggcacggagtggagggaacgtcttgggaaaggggagagcttgacctccatctaggtttcttttatctggagaaaaagaacacttttgaactatgtaatgcttcgccctgaaaggcaagctaacgctaacttcccaggtgacagtagcaggaacaaggaagggtaatgtttccatgacagacacttgcttcccttgggacaagtcccagaagaactacctgaagcaccaaagctccccaccccagcctggtggcagaggaagcaggtggcaccaactcaccaaagggacttgggagccaccttctcactctgtggaagtactttagtgagagctgactggcaagataaaaaccctgaaattcccagaagttacagatgccttaaagactttctttggaagatcattgcctgtactattccttttttgtgtggcataaataatatattaacctgttacaactgacaacattggttttctgcagctagggagtcttgagtcgagactgctcgccttgatgacttgctcttttttggcagatgtgtggagttggctgttacgacatccctgtgtgatcccagaggaggggcagtagctgggcagaaactgcaggcacacatttgggtggatcacctggcttccagccccttcggggtggtgctcagtgtggggtgatggtatcatagaggaccacggcgcttatcagcattgtttctttggagtctgtgtaatggaatgtatttttcaaatactgatatttgcattttctgtaacaattccttataataaaatgaagtaaaattgtg

SEQ ID NO: 372591 - DNA, 3829 bp, Homo sapiens
agtgccgggccagacatggcggaagaggaggtggccaagttggagaagcacttgatgcttctgcggcaggagtatgtcaagctgcagaagaagctggcggagacagagaagcgctgcgctctcttggctgcgcaggcaaacaaggagagcagcagcgagtccttcatcagccgtctgctggccatcgtggcagacctctacgagcaggagcagtacagcgatctgaagataaaggttggggacaggcacatcagtgctcacaagtttgtcctggcagcccgcagtgacagctggagtctggctaacttgtcttccactaaagagttggacctgtcagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggacgacctgaggaaggaggatttcagcagcatgagcgctcagttgttatacaaaatgatcaaatccaagacagagtacccgctacataaagccatcaaagtggagagagaagacgtggtcttcctgtatctgattgaaatggattcccagctccctgggaagctgaatgaagcggatcataacggagatctggcattagatctagccctctcacgacgactggagagtattgccaccacgctggttagtcacaaagctgatgtggacatggtggacaagagtggctggagcttgttacacaaaggaatccaaagaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggactcctttacatgtgtccatcatggccgggaatgaatatgtgttcagtcagctgctgcagtgcaaacaactagatttagaactcaaagaccacgagggcagcacggctctgtggctggcagtgcagcatatcacagtgtcttctgaccagtctgtgaaccccttcgaagatgtccccgtggtaaatgggacttcatttgatgagaacagctttgcagccagactcatccagcgcggcagccacacagacgcacctgacacggcgacaggaaactgtttactacagcgggcagctggagcaggaaacgaggcagcagctcttttcctggcaaccaacggtgcccatgtcaaccacagaaacaagtggggagaaaccccgttgcacacagcgtgtcggcatggcctggccaacctcacagcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctgctgggctctggagccgccatcaatgacaccatgtcggatgggcagacgctactgcacatggccatacagcggcaggacagcaagagcgcactcttcctgctggagcaccaggcagatataaatgtcaggactcaggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgagacagacaagggctgaccccgtttgcctgtgccatgactttcaagaacaacaagtcagccgaggccattctcaaacgagagtccggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgtggtaagaccccagcgtcactggcaaggagcgaggggactgccgctgatgtcattgcttccccccttctccaggacaggccgtgaacttgcctgggtcctgcacattgatgggcaaaccttgaccaaatggagggatgagatgagcacacccaaggatcctactgaggaacagagatgtagggaaggcagggagcctgcagacgggtggctttcctgctggaggctgaaggtgcacagtttccaggcagcctgccaggcctgtgccatccttcctgacttcctgcctgcaccaaagctgagatgagctactgccctcatggtgtgcctcagtatgggccgctttgccgagaactaaggggctgttcccattaaaatgagattacaggcgtgagccaccatgcctggcctgagctgctcttgatcttccaaaaaaaaa

SEQ ID NO: 372592 - DNA, 419 bp, Homo sapiens
gcggcaggacagcaagagcgcactcttcctgctggagcaccaggcagatataaatgtcaggtaggaggaagccgctctctccacctaacaccaggtaacaattaattgagatgtcaaaagcatagcctcgcttgtagaaaagtgtttttgtttcatattagttagaggaaaggaaacagtagctctagaaacacacaactgcggtgtcatcactgaatatcatcaaaagacttgattgtaatggcggaaaggaactgtcctttgctcttgtttgaacctttcaggaccagtgcatagtattgcacaagtctcattgtaaaaaacaatctaaaatccaggttttttttcctttgaggcaggatcttactcttttgcctaggctggagtgcagtggcacaatctcggctcactgcggcctc

SEQ ID NO: 372593 - DNA, 3432 bp, Homo sapiens
agtgccgggccagacatggcggaagaggaggtggccaagttggagaagcacttgatgcttctgcggcaggagtatgtcaagctgcagaagaagctggcggagacagagaagcgctgcgctctcttggctgcgcaggcaaacaaggagagcagcagcgagtccttcatcagccgtctgctggccatcgtggcagacctctacgagcaggagcagtacagcgatctgaagataaaggttggggacaggcacatcagtgctcacaagtttgtcctggcagcccgcagtgacagctggagtctggctaacttgtcttccactaaagagttggacctgtcagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggacgacctgaggaaggaggatttcagcagcatgagcgctcagttgttatacaaaatgatcaaatccaagacagagtacccgctacataaagccatcaaagtggagagagaagacgtggtcttcctgtatctgattgaaatggattcccagctccctgggaagctgaatgaagcggatcataacggagatctggcattagatctagccctctcacgacgactggagagtattgccaccacgctggttagtcacaaagctgatgtggacatggtggacaagagtggctggagcttgttacacaaaggaatccaaagaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggactcctttacatgtgtccatcatggccgggaatgaatatgtgttcagtcagctgctgcagtgcaaacaactagatttagaactcaaagaccacgagggcagcacggctctgtggctggcagtgcagcatatcacagtgtcttctgaccagtctgtgaaccccttcgaagatgtccccgtggtaaatgggacttcatttgatgagaacagctttgcagccagactcatccagcgcggcagccacacagacgcacctgacacggcgacaggaaactgtttactacagcgggcagctggagcaggaaacgaggcagcagctcttttcctggcaaccaacggtgcccatgtcaaccacagaaacaagtggggagaaaccccgttgcacacagcgtgtcggcatggcctggccaacctcacagcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctgctgggctctggagccgccatcaatgacaccatgtcggatgggcagacgctactgcacatggccatacagcggcaggacagcaagagcgcactcttcctgctggagcaccaggcagatataaatgtcaggactcaggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgagacagacaagggctgaccccgtttgcctgtgccatgactttcaagaacaacaagtcagccgaggccattctcaaacgagagtccggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgcatgcctggcctgagctgctcttgatcttccaaaaaaaaa

SEQ ID NO: 372594 - DNA, 7397 bp, Homo sapiens
agtgccgggccagacatggcggaagaggaggtggccaagttggagaagcacttgatgcttctgcggcaggagtatgtcaagctgcagaagaagctggcggagacagagaagcgctgcgctctcttggctgcgcaggcaaacaaggagagcagcagcgagtccttcatcagccgtctgctggccatcgtggcagacctctacgagcaggagcagtacagcgatctgaagataaaggttggggacaggcacatcagtgctcacaagtttgtcctggcagcccgcagtgacagctggagtctggctaacttgtcttccactaaagagttggacctgtcagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggacgacctgaggaaggaggatttcagcagcatgagcgctcagttgttatacaaaatgatcaaatccaagacagagtacccgctacataaagccatcaaagtggagagagaagacgtggtcttcctgtatctgattgaaatggattcccagctccctgggaagctgaatgaagcggatcataacggagatctggcattagatctagccctctcacgacgactggagagtattgccaccacgctggttagtcacaaagctgatgtggacatggtggacaagagtggctggagcttgttacacaaaggaatccaaagaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggactcctttacatgtgtccatcatggccgggaatgaatatgtgttcagtcagctgctgcagtgcaaacaactagatttagaactcaaagaccacgagggcagcacggctctgtggctggcagtgcagcatatcacagtgtcttctgaccagtctgtgaaccccttcgaagatgtccccgtggtaaatgggacttcatttgatgagaacagctttgcagccagactcatccagcgcggcagccacacagacgcacctgacacggcgacaggaaactgtttactacagcgggcagctggagcaggaaacgaggcagcagctcttttcctggcaaccaacggtgcccatgtcaaccacagaaacaagtggggagaaaccccgttgcacacagcgtgtcggcatggcctggccaacctcacagcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctgctgggctctggagccgccatcaatgacaccatgtcggatgggcagacgctactgcacatggccatacagcggcaggacagcaagagcgcactcttcctgctggagcaccaggcagatataaatgtcaggactcaggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgagacagacaagggctgaccccgtttgcctgtgccatgactttcaagaacaacaagtcagccgaggccattctcaaacgagagtccggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgtcgtcactgcggacgtcttctttgccataaatgctcgaccaaggagattcctattataaagtttgatctgaacaagcctgtgcgggtttgcaacatttgttttgatgtactgactctgggtggggtttcttagtgagccccccggagggtccaggccacgtccttggtcacctccccagcagctgctctgctcaccagcctgaccccacccagagcaggagctggcgggtgtcttcctgcggcaatagactggaacgattaaggaccatggtgtgatagatcccatttcaaatgattccatatgattgtcagtgtgtgtgtcagactgtgatcgatttcactagatgtctcactcatcagaccaggccattgggcctaagtggtaaatgtgattaggaattagacctctccccattctgctagcaacatacagggacacttggaaaaccatttccccttccagtagcttggtgtccatcccagagcattcatgaagtcttcccgcctgggctgactgatgaggcagagcctctcagcgtaggaagctggctgcttaatgagctggctttactctagggtaagtggctgtggacttttctgcacagtgttttcataaagataataggatcctcttgccctgaagtctttttttctttttacgctaagctgtatttttagtgagctaccccttttaaaaaggtgaaatctttcttaacagggttcaaagatgagagctgaaaaatcgtggccttaacaactgaaagctttacagtgttcatgctactgaggtgtcaggagtgcagctgggccgcttgacacctcgtagcagccgtctcattctctcgtcttgctgcgtcctgtctgtggagtcctcagtcactctgctgttggagagtgctggaggaaatgcacttttactgtgctgcactttttatagagctgcattgtcggtgattccaatttaaaaatccatattcaaaaataccctcacacatccctgcatcagtgattctaatgatcagctttgactggacctcagctcacacgaatctccaaggaaaaactctacagagcatcttttagagcaagagattcatacaggccaagtgatgagagggggagtcaccaaggcttcagccccaagggcatctccagcctcaggccggcaggtcctatgtccttgacacaaacgcttcttgctgaaatcctccctagtgatgctgcgagtgctgttggtcccagttctgtgtagcttgccctgccccatgaagggccaccagccaagggccctggccacgtgtgcgccaccttactttggaagtctctggcttgtgtgctggatgaggctgccagaacttgttgggcgttcatcgctgttagtacatatattaaccgtgaggtgttaaacttttcttttgaaggtttggccagtttctaaaaaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagtgtgtcctctgtattgcggtagatttatacattctgttgcctaaatatgtgtgtaaaatgagctgataaactggagtactacttaaaaaaaagtctgtgatttataagatgtatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttggccatgtgaggcatgtggtcagtttccattttctattacctggaaagggccataaggaagcaggcagggcttaggtagcttggttacctaagttagaaagtaagagaatcatggttcggatatgaattgaagtggttggtacatggatacctgttctttaaaaggaatgtgggagatgagtcaagggtgaggccgattgttctgcccatgccctaccataccaatttcaataacaatcttgcctgtcattgcactcagaatcttaagatcatgtttcaaatatgttgattcaaacttgcttctaagcctgagtccagggatagcaatggtactgaccagctatggactgggagaacattgagtcctgttttccattggcttcagggcgcatccatgtggatataggaaaagcctctttccacagacttaggaagccccccgaccacgcggacgctcgctgggctgcactcagcaggctgcttgagtgggagctgactccaacatgccctgccctggctgggactaggcatgcttccagcccttcccgtgctctccctgctgtcaacacttgcgtacaaacctgcctagctgttgtaagttttcatcagtagcttaagtactagtagcaaaaacttaaattcattcagaaagttgccacttctgaatgagtagagcaggaaaagtaaactttactgaaacataatttgctgcaacagtcaacattgttatgctgaatgtgctctcaactgccctttgctcatcgccagatttattatccagtgtattcctaacagtcttttgttgtcgttgtttttaaaacaaaggtacggaccatgtgctatatataaatcgaatggcttaaactaatttgctatgatcctctaacaccgaaatttcccataaacttaagtgcctacacttaggacttttgaactttcagtcatctttttcgtggtgtctcactgaacgatgtgttagaacatgtgttccatttggagttttgggcctgtgcacggtcaaccccaattaccaatttagttgaggctggattcgattgctcagttcacctgccacgttctctccaaggagtggggtctacgtgacctttagtcctctacctcagagccccgagtcatttctgaccaccccgttctgtgtcctcactcttgtccctgaatgggtccctgtgtggatctcagtgtgtgtgtggtttctccactcctccccgctcatgtcccacacctgccatattgaaccgtttctgcactaatcttctccacgggcacggagtggagggaacgtcttgggaaaggggagagcttgacctccatctaggtttcttttatctggagaaaaagaacacttttgaactatgtaatgcttcgccctgaaaggcaagctaacgctaacttcccaggtgacagtagcaggaacaaggaagggtaatgtttccatgacagacacttgcttcccttgggacaagtcccagaagaactacctgaagcaccaaagctccccaccccagcctggtggcagaggaagcaggtggcaccaactcaccaaagggacttgggagccaccttctcactctgtggaagtactttagtgagagctgactggcaagataaaaaccctgaaattcccagaagttacagatgccttaaagactttctttggaagatcattgcctgtactattccttttttgtgtggcataaataatatattaacctgttacaactgacaacattggttttctgcagctagggagtcttgagtcgagactgctcgccttgatgacttgctcttttttggcagatgtgtggagttggctgttacgacatccctgtgtgatcccagaggaggggcagtagctgggcagaaactgcaggcacacatttgggtggatcacctggcttccagccccttcggggtggtgctcagtgtggggtgatggtatcatagaggaccacggcgcttatcagcattgtttctttggagtctgtgtaatggaatgtatttttcaaatactgatatttgcattttctgtaacaattccttataataaaatgaagtaaaattgtg

SEQ ID NO: 372595 - DNA, 7824 bp, Homo sapiens
agtgccgggccagacatggcggaagaggaggtggccaagttggagaagcacttgatgcttctgcggcaggagtatgtcaagctgcagaagaagctggcggagacagagaagcgctgcgctctcttggctgcgcaggcaaacaaggagagcagcagcgagtccttcatcagccgtctgctggccatcgtggcagacctctacgagcaggagcagtacagcgatctgaagataaaggttggggacaggcacatcagtgctcacaagtttgtcctggcagcccgcagtgacagctggagtctggctaacttgtcttccactaaagagttggacctgtcagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggacgacctgaggaaggaggatttcagcagcatgagcgctcagttgttatacaaaatgatcaaatccaagacagagtacccgctacataaagccatcaaagtggagagagaagacgtggtcttcctgtatctgattgaaatggattcccagctccctgggaagctgaatgaagcggatcataacggagatctggcattagatctagccctctcacgacgactggagagtattgccaccacgctggttagtcacaaagctgatgtggacatggtggacaagagtggctggagcttgttacacaaaggaatccaaagaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggactcctttacatgtgtccatcatggccgggaatgaatatgtgttcagtcagctgctgcagtgcaaacaactagatttagaactcaaagaccacgagggcagcacggctctgtggctggcagtgcagcatatcacagtgtcttctgaccagtctgtgaaccccttcgaagatgtccccgtggtaaatgggacttcatttgatgagaacagctttgcagccagactcatccagcgcggcagccacacagacgcacctgacacggcgacaggaaactgtttactacagcgggcagctggagcaggaaacgaggcagcagctcttttcctggcaaccaacggtgcccatgtcaaccacagaaacaagtggggagaaaccccgttgcacacagcgtgtcggcatggcctggccaacctcacagcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctgctgggctctggagccgccatcaatgacaccatgtcggatgggcagacgctactgcacatggccatacagcggcaggacagcaagagcgcactcttcctgctggagcaccaggcagatataaatgtcaggactcaggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgagacagacaagggctgaccccgtttgcctgtgccatgactttcaagaacaacaagtcagccgaggccattctcaaacgagagtccggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgtcgtcactgcggacgtcttctttgccataaatgctcgaccaaggagattcctattataaagtttgatctgaacaagcctgtgcgggtttgcaacatttgttttgatgtactgactctgggtggggtttcttagtgagccccccggagggtccaggccacgtccttggtcacctccccagcagctgctctgctcaccagcctgaccccacccagagcaggagctggcgggtgtcttcctgcggcaatagactggaacgattaaggaccatggtgtgatagatcccatttcaaatgattccatatgattgtcagtgtgtgtgtcagactgtgatcgatttcactagatgtctcactcatcagaccaggccattgggcctaagtggtaaatgtgattaggaattagacctctccccattctgctagcaacatacagggacacttggaaaaccatttccccttccagtagcttggtgtccatcccagagcattcatgaagtcttcccgcctgggctgactgatgaggcagagcctctcagcgtaggaagctggctgcttaatgagctggctttactctagggtaagtggctgtggacttttctgcacagtgttttcataaagataataggatcctcttgccctgaagtctttttttctttttacgctaagctgtatttttagtgagctaccccttttaaaaaggtgaaatctttcttaacagggttcaaagatgagagctgaaaaatcgtggccttaacaactgaaagctttacagtgttcatgctactgaggtgtcaggagtgcagctgggccgcttgacacctcgtagcagccgtctcattctctcgtcttgctgcgtcctgtctgtggagtcctcagtcactctgctgttggagagtgctggaggaaatgcacttttactgtgctgcactttttatagagctgcattgtcggtgattccaatttaaaaatccatattcaaaaataccctcacacatccctgcatcagtgattctaatgatcagctttgactggacctcagctcacacgaatctccaaggaaaaactctacagagcatcttttagagcaagagattcatacaggccaagtgatgagagggggagtcaccaaggcttcagccccaagggcatctccagcctcaggccggcaggtcctatgtccttgacacaaacgcttcttgctgaaatcctccctagtgatgctgcgagtgctgttggtcccagttctgtgtagcttgccctgccccatgaagggccaccagccaagggccctggccacgtgtgcgccaccttactttggaagtctctggcttgtgtgctggatgaggctgccagaacttgttgggcgttcatcgctgttagtacatatattaaccgtgaggtgttaaacttttcttttgaaggtttggccagtttctaaaaaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagtgtgtcctctgtattgcggtagatttatacattctgttgcctaaatatgtgtgtaaaatgagctgataaactggagtactacttaaaaaaaagtctgtgatttataagatgtatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttggccatgtgaggcatgtggtcagtttccattttctattacctggaaagggccataaggaagcaggcagggcttaggtagcttggttacctaagttagaaagtaagagaatcatggttcggatatgaattgaagtggttggtacatggatacctgttctttaaaaggaatgtgggagatgagtcaagggtgaggccgattgttctgcccatgccctaccataccaatttcaataacaatcttgcctgtcattgcactcagaatcttaagatcatgtttcaaatatgttgattcaaacttgcttctaagcctgagtccagggatagcaatggtactgaccagctatggactgggagaacattgagtcctgttttccattggcttcagggcgcatccatgtggatataggaaaagcctctttccacagacttaggaagccccccgaccacgcggacgctcgctgggctgcactcagcaggctgcttgagtgggagctgactccaacatgccctgccctggctgggactaggcatgcttccagcccttcccgtgctctccctgctgtcaacacttgcgtacaaacctgcctagctgttgtaagttttcatcagtagcttaagtactagtagcaaaaacttaaattcattcagaaagttgccacttctgaatgagtagagcaggaaaagtaaactttactgaaacataatttgctgcaacagtcaacattgttatgctgaatgtgctctcaactgccctttgctcatcgccagatttattatccagtgtattcctaacagtcttttgttgtcgttgtttttaaaacaaaggtacggaccatgtgctatatataaatcgaatggcttaaactaatttgctatgatcctctaacaccgaaatttcccataaacttaagtgcctacacttaggacttttgaactttcagtcatctttttcgtggtgtctcactgaacgatgtgttagaacatgtgttccatttggagttttgggcctgtgcacggtcaaccccaattaccaatttagttgaggctggattcgattgctcagttcacctgccacgttctctccaaggagtggggtctacgtgacctttagtcctctacctcagagccccgagtcatttctgaccaccccgttctgtgtcctcactcttgtccctgaatgggtccctgtgtggatctcagtgtgtgtgtggtttctccactcctccccgctcatgtcccacacctgccatattgaaccgtttctgcactaatcttctccacgggcacggagtggagggaacgtcttgggaaaggggagagcttgacctccatctaggtttcttttatctggagaaaaagaacacttttgaactatgtaatgcttcgccctgaaaggcaagctaacgctaacttcccaggtgacagtagcaggaacaaggaagggtaatgtttccatgacagacacttgcttcccttgggacaagtcccagaagaactacctgaagcaccaaagctccccaccccagcctggtggcagaggaagcaggtggcaccaactcaccaaagggacttgggagccaccttctcactctgtggaagtactttagtgagagctgactggcaagataaaaaccctgaaattcccagaagttacagatgccttaaagactttctttggaagatcattgcctgtactattccttttttgtgtggcataaataatatattaacctgttacaactgacaacattggttttctgcagctagggagtcttgagtcgagactgctcgccttgatgacttgctcttttttggcagatgtgtggagttggctgttacgacatccctgtgtgatcccagaggaggggcagtagctgggcagaaactgcaggcacacatttgggtggatcacctggcttccagccccttcggggtggtgctcagtgtggggtgatggtatcatagaggaccacggcgcttatcagcattgtttctttggagtctgtgtaatggaatgtatttttcaaatactgatatttgcattttctgtaacaattccttataataaaatgaagtaaaattgtgcatttaaagtggaaactttaataagacatttgtagttacttctaatgcagaagtaccaataagcattaaaaacaaattttagaaaactcctgacgtgaataagtttcttgaccagctgccctccagaaagtttgaattccaacatttttcaggaacatgctgttgacagcagtaaaagtagctattttatgtatgtatttttaatttttaaaagtttcagtaggtttttggggttcaggtggtgtttggttacgtgaggttctttagcggtgatttccaggattttggggcacccatcacccaagcagtgtacactggacccttttatccctcaccccaaccctttcccctgagtccccaaagtccactgtatcattcttaatgcctttacgtcctcatggcttagctcccgaaaagtagttatttt

SEQ ID NO: 372596 - DNA, 5401 bp, Homo sapiens
ttttaaagtaattatcaatttattatcaaccgtatcttatctgaaagtggatttaatgctatacatagagctcagacttggtaataaaactgtttgcctttgctcagcagtgtttgtgaataacctatgtttttctgcaggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgagacagacaagggctgaccccgtttgcctgtgccatgactttcaagaacaacaagtcagccgaggccattctcaaacgagagtccggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgtcgtcactgcggacgtcttctttgccataaatgctcgaccaaggagattcctattataaagtttgatctgaacaagcctgtgcgggtttgcaacatttgttttgatgtactgactctgggtggggtttcttagtgagccccccggagggtccaggccacgtccttggtcacctccccagcagctgctctgctcaccagcctgaccccacccagagcaggagctggcgggtgtcttcctgcggcaatagactggaacgattaaggaccatggtgtgatagatcccatttcaaatgattccatatgattgtcagtgtgtgtgtcagactgtgatcgatttcactagatgtctcactcatcagaccaggccattgggcctaagtggtaaatgtgattaggaattagacctctccccattctgctagcaacatacagggacacttggaaaaccatttccccttccagtagcttggtgtccatcccagagcattcatgaagtcttcccgcctgggctgactgatgaggcagagcctctcagcgtaggaagctggctgcttaatgagctggctttactctagggtaagtggctgtggacttttctgcacagtgttttcataaagataataggatcctcttgccctgaagtctttttttctttttacgctaagctgtatttttagtgagctaccccttttaaaaaggtgaaatctttcttaacagggttcaaagatgagagctgaaaaatcgtggccttaacaactgaaagctttacagtgttcatgctactgaggtgtcaggagtgcagctgggccgcttgacacctcgtagcagccgtctcattctctcgtcttgctgcgtcctgtctgtggagtcctcagtcactctgctgttggagagtgctggaggaaatgcacttttactgtgctgcactttttatagagctgcattgtcggtgattccaatttaaaaatccatattcaaaaataccctcacacatccctgcatcagtgattctaatgatcagctttgactggacctcagctcacacgaatctccaaggaaaaactctacagagcatcttttagagcaagagattcatacaggccaagtgatgagagggggagtcaccaaggcttcagccccaagggcatctccagcctcaggccggcaggtcctatgtccttgacacaaacgcttcttgctgaaatcctccctagtgatgctgcgagtgctgttggtcccagttctgtgtagcttgccctgccccatgaagggccaccagccaagggccctggccacgtgtgcgccaccttactttggaagtctctggcttgtgtgctggatgaggctgccagaacttgttgggcgttcatcgctgttagtacatatattaaccgtgaggtgttaaacttttcttttgaaggtttggccagtttctaaaaaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagtgtgtcctctgtattgcggtagatttatacattctgttgcctaaatatgtgtgtaaaatgagctgataaactggagtactacttaaaaaaaagtctgtgatttataagatgtatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttggccatgtgaggcatgtggtcagtttccattttctattacctggaaagggccataaggaagcaggcagggcttaggtagcttggttacctaagttagaaagtaagagaatcatggttcggatatgaattgaagtggttggtacatggatacctgttctttaaaaggaatgtgggagatgagtcaagggtgaggccgattgttctgcccatgccctaccataccaatttcaataacaatcttgcctgtcattgcactcagaatcttaagatcatgtttcaaatatgttgattcaaacttgcttctaagcctgagtccagggatagcaatggtactgaccagctatggactgggagaacattgagtcctgttttccattggcttcagggcgcatccatgtggatataggaaaagcctctttccacagacttaggaagccccccgaccacgcggacgctcgctgggctgcactcagcaggctgcttgagtgggagctgactccaacatgccctgccctggctgggactaggcatgcttccagcccttcccgtgctctccctgctgtcaacacttgcgtacaaacctgcctagctgttgtaagttttcatcagtagcttaagtactagtagcaaaaacttaaattcattcagaaagttgccacttctgaatgagtagagcaggaaaagtaaactttactgaaacataatttgctgcaacagtcaacattgttatgctgaatgtgctctcaactgccctttgctcatcgccagatttattatccagtgtattcctaacagtcttttgttgtcgttgtttttaaaacaaaggtacggaccatgtgctatatataaatcgaatggcttaaactaatttgctatgatcctctaacaccgaaatttcccataaacttaagtgcctacacttaggacttttgaactttcagtcatctttttcgtggtgtctcactgaacgatgtgttagaacatgtgttccatttggagttttgggcctgtgcacggtcaaccccaattaccaatttagttgaggctggattcgattgctcagttcacctgccacgttctctccaaggagtggggtctacgtgacctttagtcctctacctcagagccccgagtcatttctgaccaccccgttctgtgtcctcactcttgtccctgaatgggtccctgtgtggatctcagtgtgtgtgtggtttctccactcctccccgctcatgtcccacacctgccatattgaaccgtttctgcactaatcttctccacgggcacggagtggagggaacgtcttgggaaaggggagagcttgacctccatctaggtttcttttatctggagaaaaagaacacttttgaactatgtaatgcttcgccctgaaaggcaagctaacgctaacttcccaggtgacagtagcaggaacaaggaagggtaatgtttccatgacagacacttgcttcccttgggacaagtcccagaagaactacctgaagcaccaaagctccccaccccagcctggtggcagaggaagcaggtggcaccaactcaccaaagggacttgggagccaccttctcactctgtggaagtactttagtgagagctgactggcaagataaaaaccctgaaattcccagaagttacagatgccttaaagactttctttggaagatcattgcctgtactattccttttttgtgtggcataaataatatattaacctgttacaactgacaacattggttttctgcagctagggagtcttgagtcgagactgctcgccttgatgacttgctcttttttggcagatgtgtggagttggctgttacgacatccctgtgtgatcccagaggaggggcagtagctgggcagaaactgcaggcacacatttgggtggatcacctggcttccagccccttcggggtggtgctcagtgtggggtgatggtatcatagaggaccacggcgcttatcagcattgtttctttggagtctgtgtaatggaatgtatttttcaaatactgatatttgcattttctgtaacaattccttataataaaatgaagtaaaattgtg

SEQ ID NO: 372597 - DNA, 6597 bp, Homo sapiens
agtgccgggccagacatggcggaagaggaggtggccaagttggagaagcacttgatgcttctgcggcaggagtatgtcaagctgcagaagaagctggcggagacagagaagcgctgcgctctcttggctgcgcaggcaaacaaggagagcagcagcgagtccttcatcagccgtctgctggccatcgtggcagacctctacgagcaggagcagtacagcgatctgaagataaaggttggggacaggcacatcagtgctcacaagtttgtcctggcagcccgcagtgacagctggagtctggctaacttgtcttccactaaagagttggacctgtcagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggacgacctgaggaaggaggatttcagcagcatgagcgctcagttgttatacaaaatgatcaaatccaagacagagtacccgctacataaagccatcaaagtggagagagaagacgtggtcttcctgtatctgattgaaatggattcccagctccctgggaagctgaatgaagcggatcataacggagatctggcattagatctagccctctcacgacgactggagagtattgccaccacgctggttagtcacaaagctgatgtggacatggtggacaagagtggctggagcttgttacacaaaggaatccaaagaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggactcctttacatgtgtccatcatggccgggaatgaatatgtgttcagtcagctgctgcagtgcaaacaactagatttagaactcaaagaccacgagggcagcacggctctgtggctggcagtgcagcatatcacagtgtcttctgaccagtctgtgaaccccttcgaagatgtccccgtggtaaatgggacttcatttgatgagaacagctttgcagccagactcatccagcgcggcagccacacagacgcacctgacacggcgacaggaaactgtttactacagcgggcagctggagcaggaaacgaggcagcagctcttttcctggcaaccaacggtgcccatgtcaaccacagaaacaagtggggagaaaccccgttgcacacagcgtgtcggcatggcctggccaacctcacagcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctgctgggctctggagccgccatcaatgacaccatgtcggatgggcagacgctactgcacatggccatacagcggcaggacagcaagagcgcactcttcctgctggagcaccaggcagatataaatgtcaggactcaggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgagacagacaagggctgaccccgtttgcctgtgccatgactttcaagaacaacaagtcagccgaggccattctcaaacgagagtccggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgtcgtcactgcggacgtcttctttgccataaatgctcgaccaaggagattcctattataaagtttgatctgaacaagcctgtgcgggtttgcaacatttgttttgatgtactgactctgggtggggtttcttagtgagccccccggagggtccaggccacgtccttggtcacctccccagcagctgctctgctcaccagcctgaccccacccagagcaggagctggcgggtgtcttcctgcggcaatagactggaacgattaaggaccatggtgtgatagatcccatttcaaatgattccatatgattgtcagtgtgtgtgtcagactgtgatcgatttcactagatgtctcactcatcagaccaggccattgggcctaagtggtaaatgtgattaggaattagacctctccccattctgctagcaacatacagggacacttggaaaaccatttccccttccagtagcttggtgtccatcccagagcattcatgaagtcttcccgcctgggctgactgatgaggcagagcctctcagcgtaggaagctggctgcttaatgagctggctttactctagggtaagtggctgtggacttttctgcacagtgttttcataaagataataggatcctcttgccctgaagtctttttttctttttacgctaagctgtatttttagtgagctaccccttttaaaaaggtgaaatctttcttaacagggttcaaagatgagagctgaaaaatcgtggccttaacaactgaaagctttacagtgttcatgctactgaggtgtcaggagtgcagctgggccgcttgacacctcgtagcagccgtctcattctctcgtcttgctgcgtcctgtctgtggagtcctcagtcactctgctgttggagagtgctggaggaaatgcacttttactgtgctgcactttttatagagctgcattgtcggtgattccaatttaaaaatccatattcaaaaataccctcacacatccctgcatcagtgattctaatgatcagctttgactggacctcagctcacacgaatctccaaggaaaaactctacagagcatcttttagagcaagagattcatacaggccaagtgatgagagggggagtcaccaaggcttcagccccaagggcatctccagcctcaggccggcaggtcctatgtccttgacacaaacgcttcttgctgaaatcctccctagtgatgctgcgagtgctgttggtcccagttctgtgtagcttgccctgccccatgaagggccaccagccaagggccctggccacgtgtgcgccaccttactttggaagtctctggcttgtgtgctggatgaggctgccagaacttgttgggcgttcatcgctgttagtacatatattaaccgtgaggtgttaaacttttcttttgaaggtttggccagtttctaaaaaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagtgtgtcctctgtattgcggtagatttatacattctgttgcctaaatatgtgtgtaaaatgagctgataaactggagtactacttaaaaaaaagtctgtgatttataagatgtatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttggccatgtgaggcatgtggtcagtttccattttctattacctggaaagggccataaggaagcaggcagggcttaggtagcttggttacctaagttagaaagtaagagaatcatggttcggatatgaattgaagtggttggtacatggatacctgttctttaaaaggaatgtgggagatgagtcaagggtgaggccgattgttctgcccatgccctaccataccaatttcaataacaatcttgcctgtcattgcactcagaatcttaagatcatgtttcaaatatgttgattcaaacttgcttctaagcctgagtccagggatagcaatggtactgaccagctatggactgggagaacattgagtcctgttttccattggcttcagggcgcatccatgtggatataggaaaagcctctttccacagacttaggaagccccccgaccacgcggacgctcgctgggctgcactcagcaggctgcttgagtgggagctgactccaacatgccctgccctggctgggactaggcatgcttccagcccttcccgtgctctccctgctgtcaacacttgcgtacaaacctgcctagctgtttgtggagttggctgttacgacatccctgtgtgatcccagaggaggggcagtagctgggcagaaactgcaggcacacatttgggtggatcacctggcttccagccccttcggggtggtgctcagtgtggggtgatggtatcatagaggaccacggcgcttatcagcattgtttctttggagtctgtgtaatggaatgtatttttcaaatactgatatttgcattttctgtaacaattccttataataaaatgaagtaaaattgtgcatttaaagtggaaactttaataagacatttgtagttacttctaatgcagaagtaccaataagcattaaaaacaaattttagaaaactcctgacgtgaataagtttcttgaccagctgccctccagaaagtttgaattccaacatttttcaggaacatgctgttgacagcagtaaaagtagctattttatgtatgtatttttaatttttaaaagtttcagtaggtttttggggttcaggtggtgtttggttacgtgaggttctttagcggtgatttccaggattttggggcacccatcacccaagcagtgtacactggacccttttatccctcaccccaaccctttcccctgagtccccaaagtccactgtatcattcttaatgcctttacgtcctcatggcttagctcccgaaaagtagttatttt

SEQ ID NO: 372598 - DNA, 747 bp, Homo sapiens
agtgccgggccagacatggcggaagaggaggtggccaagttggagaagcacttgatgcttctgcggcaggagtatgtcaagctgcagaagaagctggcggagacagagaagcgctgcgctctcttggctgcgcaggcaaacaaggagagcagcagcgagtccttcatcagccgtctgctggccatcgtggcagacctctacgagcaggagcagtacagcgatctgaagataaaggttggggacaggcacatcagtgctcacaagtttgtcctggcagcccgcagtgacagctggagtctggctaacttgtcttccactaaagagttggacctgtcagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggtgagtgaggttgagggtgtcaacaaagcactctagctggcagtcaggagaccgccgctggggacgtagttccatggaaagtgacctctctggcacctggttttctcttgttacacaattgaagaataaatagtttgattagatgatcta

SEQ ID NO: 372599 - DNA, 4509 bp, Homo sapiens
  misc_feature (1693)..(1693): n is a, c, g, or t
  misc_feature (3896)..(3896): n is a, c, g, or t
tgcttattaattacattttaaaatgaagggttacaaaaagagatgagcctggcatttctaattcgggggccttgggacctctcccctccaagtgcaagttgtagcaacctgccgggtccacgcatgggcgggtcatactccacgggttccggtttccactccctgtgaaccaaaagccagagaggcccacgcacgagtccggaagtgagggagggaggactttcgtacgcagccgcctcccagctggaacctcatctttagtgctcggccgcgggcggcgtaactcggggttccgcctcggaatacctcccacttctcttgtctaagaggagcagtagcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatanacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctcnttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcaaaaaaaaaaaactt

SEQ ID NO: 372600 - DNA, 5605 bp, Homo sapiens
  misc_feature (1693)..(1693): n is a, c, g, or t
  misc_feature (4992)..(4992): n is a, c, g, or t
tgcttattaattacattttaaaatgaagggttacaaaaagagatgagcctggcatttctaattcgggggccttgggacctctcccctccaagtgcaagttgtagcaacctgccgggtccacgcatgggcgggtcatactccacgggttccggtttccactccctgtgaaccaaaagccagagaggcccacgcacgagtccggaagtgagggagggaggactttcgtacgcagccgcctcccagctggaacctcatctttagtgctcggccgcgggcggcgtaactcggggttccgcctcggaatacctcccacttctcttgtctaagaggagcagtagcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatanacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggtaggcccagggccccttcctgtggggagcaggcagggtgtggcatgagctgaccagaggctgtgttgtaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctgtgagtagcctgtgctcaccttgtcctcgcttccaccctgggcaaaaggttggatggcatagcagggaggaaaacagccctgacgggatgggacgggctggtcacggcttgtcacagctgagctgctgggaaccccctcttctccagccagatcccatccctcccacggcaagagggagagaatggagtgggatttccaaaccctctctcctttgcctggccaaagctcaggaaataggtgtcccctcctctgcaagacttcctaacctctctccgtcctgctgacacgatcttttccgggagtcatacacgttgttgacaaagggaacaagctcagctcctacccgtgcctgccggcctctcttctgctccatcacagccaagacactggctttttgtcagaagcccctctttcttgtgtgagctggcacctgtccctctgcccacccctactatggtctcctcaaaccctaacctgccctgccccatgctgatgaagctggtggctcccacagcaaccagcactacccgagagccttgggcctcgggggagatgtcaggtgggtgcatggggcctgggtcccggtccctgctgtgctcctcactgtttgactgaccttgatgggatcctgaacgtctcagaggctgctcccctgtgacatggaccctggcgacctgtacaccagcgtcaccagggttgttctgcaggtcaaaagagacaatgtgggtgaagcagtcccctggcgtcaggtaccttttgtcggaactgctgggagctctatggcccaggcccaccccagcttacttgctgaccttggcctcgcctttcctgactttcagtctccctataaaattggagatcccacagagatctcagacccccctgcagcccctggtcagcccaggggaacagaccccatgtttctttccagcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctcnttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcaaaaaaaaaaaactt

SEQ ID NO: 372601 - DNA, 4601 bp, Homo sapiens
  misc_feature (1693)..(1693): n is a, c, g, or t
  misc_feature (3988)..(3988): n is a, c, g, or t
tgcttattaattacattttaaaatgaagggttacaaaaagagatgagcctggcatttctaattcgggggccttgggacctctcccctccaagtgcaagttgtagcaacctgccgggtccacgcatgggcgggtcatactccacgggttccggtttccactccctgtgaaccaaaagccagagaggcccacgcacgagtccggaagtgagggagggaggactttcgtacgcagccgcctcccagctggaacctcatctttagtgctcggccgcgggcggcgtaactcggggttccgcctcggaatacctcccacttctcttgtctaagaggagcagtagcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatanacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggtaggcccagggccccttcctgtggggagcaggcagggtgtggcatgagctgaccagaggctgtgttgtaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctgcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctcnttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcaaaaaaaaaaaactt

SEQ ID NO: 372602 - DNA, 5692 bp, Homo sapiens
  misc_feature (1693)..(1693): n is a, c, g, or t
  misc_feature (4992)..(4992): n is a, c, g, or t
tgcttattaattacattttaaaatgaagggttacaaaaagagatgagcctggcatttctaattcgggggccttgggacctctcccctccaagtgcaagttgtagcaacctgccgggtccacgcatgggcgggtcatactccacgggttccggtttccactccctgtgaaccaaaagccagagaggcccacgcacgagtccggaagtgagggagggaggactttcgtacgcagccgcctcccagctggaacctcatctttagtgctcggccgcgggcggcgtaactcggggttccgcctcggaatacctcccacttctcttgtctaagaggagcagtagcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatanacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggtaggcccagggccccttcctgtggggagcaggcagggtgtggcatgagctgaccagaggctgtgttgtaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctgtgagtagcctgtgctcaccttgtcctcgcttccaccctgggcaaaaggttggatggcatagcagggaggaaaacagccctgacgggatgggacgggctggtcacggcttgtcacagctgagctgctgggaaccccctcttctccagccagatcccatccctcccacggcaagagggagagaatggagtgggatttccaaaccctctctcctttgcctggccaaagctcaggaaataggtgtcccctcctctgcaagacttcctaacctctctccgtcctgctgacacgatcttttccgggagtcatacacgttgttgacaaagggaacaagctcagctcctacccgtgcctgccggcctctcttctgctccatcacagccaagacactggctttttgtcagaagcccctctttcttgtgtgagctggcacctgtccctctgcccacccctactatggtctcctcaaaccctaacctgccctgccccatgctgatgaagctggtggctcccacagcaaccagcactacccgagagccttgggcctcgggggagatgtcaggtgggtgcatggggcctgggtcccggtccctgctgtgctcctcactgtttgactgaccttgatgggatcctgaacgtctcagaggctgctcccctgtgacatggaccctggcgacctgtacaccagcgtcaccagggttgttctgcaggtcaaaagagacaatgtgggtgaagcagtcccctggcgtcaggtaccttttgtcggaactgctgggagctctatggcccaggcccaccccagcttacttgctgaccttggcctcgcctttcctgactttcagtctccctataaaattggagatcccacagagatctcagacccccctgcagcccctggtcagcccaggggaacagaccccatgtttctttccagcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctcnttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtgaggccccaggccatccccaggtgtccctggggacgccccgggctgtgctccctctcagccctgcctgtccctccatggccccaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcaaaaaaaaaaaactt

SEQ ID NO: 372603 - DNA, 3382 bp, Homo sapiens
  misc_feature (2769)..(2769): n is a, c, g, or t
aatcaagtatcaaagatccctatggcctaaggcccgctgtccggggcacctgcttggtttgatgtgtgtcacgtgactctgttctgggacgtacaggtagtacaaggataggtaaacaaagtctccagataccttcccctgtccccacagcaagatcaggagggaagcagcagttcctaccacccatgcttgcagcgccctgtgcagcacgctgtgctgtctgtgggtactagccttgtagcgaaagcagctcctttccctggagtcccatggtttgacttaggaggtgagggcctgtgagacagtttctccctgtcgtctgggagggtctgctggccctgggaccaggggctgttggcctcttcctaccctttttgagttctctgggcatggcagccttgtggtagatgcacctctgaggcctgcctaaacagggggaagtgtgggcccaagagcagcctcagtcttccttgtcccctacagacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggtaggcccagggccccttcctgtggggagcaggcagggtgtggcatgagctgaccagaggctgtgttgtaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctgtgagtagcctgtgctcaccttgtcctcgcttccaccctgggcaaaaggttggatggcatagcagggaggaaaacagccctgacgggatgggacgggctggtcacggcttgtcacagctgagctgctgggaaccccctcttctccagccagatcccatccctcccacggcaagagggagagaatggagtgggatttccaaaccctctctcctttgcctggccaaagctcaggaaataggtgtcccctcctctgcaagacttcctaacctctctccgtcctgctgacacgatcttttccgggagtcatacacgttgttgacaaagggaacaagctcagctcctacccgtgcctgccggcctctcttctgctccatcacagccaagacactggctttttgtcagaagcccctctttcttgtgtgagctggcacctgtccctctgcccacccctactatggtctcctcaaaccctaacctgccctgccccatgctgatgaagctggtggctcccacagcaaccagcactacccgagagccttgggcctcgggggagatgtcaggtgggtgcatggggcctgggtcccggtccctgctgtgctcctcactgtttgactgaccttgatgggatcctgaacgtctcagaggctgctcccctgtgacatggaccctggcgacctgtacaccagcgtcaccagggttgttctgcaggtcaaaagagacaatgtgggtgaagcagtcccctggcgtcaggtaccttttgtcggaactgctgggagctctatggcccaggcccaccccagcttacttgctgaccttggcctcgcctttcctgactttcagtctccctataaaattggagatcccacagagatctcagacccccctgcagcccctggtcagcccaggggaacagaccccatgtttctttccagcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctcnttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcaaaaaaaaaaaactt

SEQ ID NO: 372604 - DNA, 2306 bp, Homo sapiens
  misc_feature (1693)..(1693): n is a, c, g, or t
tgcttattaattacattttaaaatgaagggttacaaaaagagatgagcctggcatttctaattcgggggccttgggacctctcccctccaagtgcaagttgtagcaacctgccgggtccacgcatgggcgggtcatactccacgggttccggtttccactccctgtgaaccaaaagccagagaggcccacgcacgagtccggaagtgagggagggaggactttcgtacgcagccgcctcccagctggaacctcatctttagtgctcggccgcgggcggcgtaactcggggttccgcctcggaatacctcccacttctcttgtctaagaggagcagtagcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatanacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcttctaaacctcgggtagcagatagaactgatcatcctgtgactcagtagcggtcgttttccaaggagcagcta

SEQ ID NO: 372605 - DNA, 2220 bp, Homo sapiens
  misc_feature (1693)..(1693): n is a, c, g, or t
  misc_feature (2220)..(2220): n is a, c, g, or t
tgcttattaattacattttaaaatgaagggttacaaaaagagatgagcctggcatttctaattcgggggccttgggacctctcccctccaagtgcaagttgtagcaacctgccgggtccacgcatgggcgggtcatactccacgggttccggtttccactccctgtgaaccaaaagccagagaggcccacgcacgagtccggaagtgagggagggaggactttcgtacgcagccgcctcccagctggaacctcatctttagtgctcggccgcgggcggcgtaactcggggttccgcctcggaatacctcccacttctcttgtctaagaggagcagtagcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatanacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatgtcattttcagcaaacagctatgcccattgctttgcattcactagcggtcgtttccn

SEQ ID NO: 372606 - DNA, 993 bp, Homo sapiens
aatcaagtatcaaagatccctatggcctaaggcccgctgtccggggcacctgcttggtttgatgtgtgtcacgtgactctgttctgggacgtacaggtagtacaaggataggtaaacaaagtctccagataccttcccctgtccccacagcaagatcaggagggaagcagcagttcctaccacccatgcttgcagcgccctgtgcagcacgctgtgctgtctgtgggtactagccttgtagcgaaagcagctcctttccctggagtcccatggtttgacttaggaggtgagggcctgtgagacagtttctccctgtcgtctgggagggtctgctggccctgggaccaggggctgttggcctcttcctaccctttttgagttctctgggcatggcagccttgtggtagatgcacctctgaggcctgcctaaacagggggaagtgtgggcccaagagcagcctcagtcttccttgtcccctacagacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtgaggtataaggaggcaagctggtcacccaggagagttgggactgtgttctggtgagggcgtgggatgtagggggtggtgccagagatttgaactgaataaggaacctagaaaatgggtaactttcctccagcacacacacaaacatccatgtgggcacatgtttagttttttactgaattacaaaccaatatgcattaaatagaaacataacacatcataagtgaactagttcttatcagaaccagtattttctttttttctttttttttttttttttttttttgagacagtctgggtgacagagtgagactccgtctcaaaaaaaaa

SEQ ID NO: 372607 - DNA, 217 bp, Homo sapiens
cctcctgccttggcctcccaaagtattaggattgcagacatgggccactgtgcccagccacttaattcacctcttatacgatagcatggtataaaaggaaaaatccaattatttggaacttctagttctgtttgggttaatttttatgtttgttttaagtgctttacattcttccttgttttttagggagacattagagaagcaagtattttctctc

SEQ ID NO: 372608 - DNA, 445 bp, Homo sapiens
cctgggcaacacagcaacactccatctcaaaaaaaaaaaaaaatgcagaggagacaggcccgtgactcagctgcactcagtggtctggggaccattcaacatgcagcaacctcagagcttccagggcaacagactggcgcctcatccttggctctgcacagggggagagagacaaggagtgtgttcttgcccaggcccacctgagttgctgtctgctggggagggcggaggagactgggagaggaaaaagaacaagtgtttggctcccaagcaggggcctgcagttcaggtcaggggccctaccagaccacctctctccacccgatacccgcatcagaattagctgaggtgcctctccctgagccggatggggctctgccaaggacccagcctggcaggcagtgggtatctccacccctcaggtcctgtcggcggcaagcgagca

SEQ ID NO: 372609 - DNA, 294 bp, Homo sapiens
ctgtggtgacacggggtgctccctggttgcttgcgggactttcccctacagtaccaggccctgtgtgcaggggcaggctagacactgagctggcacggccagtgcctgggaagcccagctcctgcagctgggagcctggtcttcccccacccctgcagggcaggcagtgacaaggacttggtgtccccctccctggcttcctcctagcttccttgctcagcatctacccttctttcctttgcaggtgtcagcacagcgggctactcctagggataagcccccggtcccctcatc

SEQ ID NO: 372610 - DNA, 436 bp, Homo sapiens
ttccctggagtcccatggtttgacttaggaggtgagggcctgtgagacagtttctccctgtcgtctgggagggtctgctggccctgggaccaggggctgttggcctcttcctaccctttttgagttctctgggcatggcagccttgtggtagatgcacctctgaggcctgcctaaacagggggaagtgtgggcccaagagcagcctcagtcttccttgtcccctacagacttaccagggcagggtgcgaagcatcctccgggaggtggcagccagggagagccagcacaacaggcagctgctgcggtgagtctcccgggcgcctcccaagctccagctggggaacaaggaatgcactccaaaccccagccttttagggggtcctgctgagggccaggtcggggatgatcccgggttcctagtcgctaatatcatgg

SEQ ID NO: 372611 - DNA, 591 bp, Homo sapiens
gagcttttaccgcaaatcaagcacttacctcatcaaatcatcacagaacccctaagaagcacgtatttatagatgaggccagagaggttaatttacactcacacagatgatgtataaaatggaggcaaagcaggaagccacccccaactcagaccccagcccacggtagctgctttctcctctgtctgcagtgcctggccctgcggggagcggagcggcagaagctgatgcgagcagacctgcaccaccagcacagcgtgctgcacagggcgctgcaggcatgggtggtaggaactgctgcttccctcctgatcttgctgtggggacaggggaggtttctggagactttgttttccttccttgttcttcctgtccgtcccagaacagagtcacgtgacacacctcaaaccaagcaggtgccccggacagcgggccttaggccatagggttctttgattcttgcttggccaagtggaaacaagtgctgtctgtgggtactagccttgtagcgaaagcagctcctttccctggagtcccatggtttgacttaggaggtgagggcctgtgagacagtttctccctgtcgtctgg

SEQ ID NO: 372612 - DNA, 4467 bp, Homo sapiens
  misc_feature (1)..(2): n is a, c, g, or t
  misc_feature (12)..(12): n is a, c, g, or t
  misc_feature (169)..(169): n is a, c, g, or t
  misc_feature (185)..(185): n is a, c, g, or t
  misc_feature (555)..(555): n is a, c, g, or t
  misc_feature (3854)..(3854): n is a, c, g, or t
nncgatacaccngtacagcagtgctattctgtagtggtcccaggcagcatgcagtaaggggagcagctctctttcctttttctgctcaatctgagaccgccagaggttccagaacctgtgcagcagcgtgacaccatgctgctggtgagcaagattccttcttatttgntggagatgagcgtggntcacattgtcttttagggctctaaagcaaaaatacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatanacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggtaggcccagggccccttcctgtggggagcaggcagggtgtggcatgagctgaccagaggctgtgttgtaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctgtgagtagcctgtgctcaccttgtcctcgcttccaccctgggcaaaaggttggatggcatagcagggaggaaaacagccctgacgggatgggacgggctggtcacggcttgtcacagctgagctgctgggaaccccctcttctccagccagatcccatccctcccacggcaagagggagagaatggagtgggatttccaaaccctctctcctttgcctggccaaagctcaggaaataggtgtcccctcctctgcaagacttcctaacctctctccgtcctgctgacacgatcttttccgggagtcatacacgttgttgacaaagggaacaagctcagctcctacccgtgcctgccggcctctcttctgctccatcacagccaagacactggctttttgtcagaagcccctctttcttgtgtgagctggcacctgtccctctgcccacccctactatggtctcctcaaaccctaacctgccctgccccatgctgatgaagctggtggctcccacagcaaccagcactacccgagagccttgggcctcgggggagatgtcaggtgggtgcatggggcctgggtcccggtccctgctgtgctcctcactgtttgactgaccttgatgggatcctgaacgtctcagaggctgctcccctgtgacatggaccctggcgacctgtacaccagcgtcaccagggttgttctgcaggtcaaaagagacaatgtgggtgaagcagtcccctggcgtcaggtaccttttgtcggaactgctgggagctctatggcccaggcccaccccagcttacttgctgaccttggcctcgcctttcctgactttcagtctccctataaaattggagatcccacagagatctcagacccccctgcagcccctggtcagcccaggggaacagaccccatgtttctttccagcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctcnttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcaaaaaaaaaaaactt

SEQ ID NO: 372613 - DNA, 3337 bp, Homo sapiens
  misc_feature (2724)..(2724): n is a, c, g, or t
attgtattgtgttctctgagacatttgacagcgttgataatttcttcttgaaactaaaaacactcttccagttcccccctgctctgagcattcttttttcctcttttctgctgtgggctttcccctgctttgccctatagatgtggttttcccatgccttcttctctttctgacccagaccatctaatcagcctccggcccccactctggctttacgtacttccagtggggccggaggctgattagatggtctgggtcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggtaggcccagggccccttcctgtggggagcaggcagggtgtggcatgagctgaccagaggctgtgttgtaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctgtgagtagcctgtgctcaccttgtcctcgcttccaccctgggcaaaaggttggatggcatagcagggaggaaaacagccctgacgggatgggacgggctggtcacggcttgtcacagctgagctgctgggaaccccctcttctccagccagatcccatccctcccacggcaagagggagagaatggagtgggatttccaaaccctctctcctttgcctggccaaagctcaggaaataggtgtcccctcctctgcaagacttcctaacctctctccgtcctgctgacacgatcttttccgggagtcatacacgttgttgacaaagggaacaagctcagctcctacccgtgcctgccggcctctcttctgctccatcacagccaagacactggctttttgtcagaagcccctctttcttgtgtgagctggcacctgtccctctgcccacccctactatggtctcctcaaaccctaacctgccctgccccatgctgatgaagctggtggctcccacagcaaccagcactacccgagagccttgggcctcgggggagatgtcaggtgggtgcatggggcctgggtcccggtccctgctgtgctcctcactgtttgactgaccttgatgggatcctgaacgtctcagaggctgctcccctgtgacatggaccctggcgacctgtacaccagcgtcaccagggttgttctgcaggtcaaaagagacaatgtgggtgaagcagtcccctggcgtcaggtaccttttgtcggaactgctgggagctctatggcccaggcccaccccagcttacttgctgaccttggcctcgcctttcctgactttcagtctccctataaaattggagatcccacagagatctcagacccccctgcagcccctggtcagcccaggggaacagaccccatgtttctttccagcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctcnttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcaaaaaaaaaaaactt

SEQ ID NO: 372614 - DNA, 2291 bp, Homo sapiens
  misc_feature (21)..(21): n is a, c, g, or t
  misc_feature (1678)..(1678): n is a, c, g, or t
gaatcgagaataggctaggtncgaggctgcgcggctgcagtgggcgctccaggcctaccaggggcagctcctccaggagggtgccacgcggctcctgcgctttgcagccagcatgaaggcctcccggcagcagctgcaggcccagcagcaggtccaggtaggcccagggccccttcctgtggggagcaggcagggtgtggcatgagctgaccagaggctgtgttgtaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctgtgagtagcctgtgctcaccttgtcctcgcttccaccctgggcaaaaggttggatggcatagcagggaggaaaacagccctgacgggatgggacgggctggtcacggcttgtcacagctgagctgctgggaaccccctcttctccagccagatcccatccctcccacggcaagagggagagaatggagtgggatttccaaaccctctctcctttgcctggccaaagctcaggaaataggtgtcccctcctctgcaagacttcctaacctctctccgtcctgctgacacgatcttttccgggagtcatacacgttgttgacaaagggaacaagctcagctcctacccgtgcctgccggcctctcttctgctccatcacagccaagacactggctttttgtcagaagcccctctttcttgtgtgagctggcacctgtccctctgcccacccctactatggtctcctcaaaccctaacctgccctgccccatgctgatgaagctggtggctcccacagcaaccagcactacccgagagccttgggcctcgggggagatgtcaggtgggtgcatggggcctgggtcccggtccctgctgtgctcctcactgtttgactgaccttgatgggatcctgaacgtctcagaggctgctcccctgtgacatggaccctggcgacctgtacaccagcgtcaccagggttgttctgcaggtcaaaagagacaatgtgggtgaagcagtcccctggcgtcaggtaccttttgtcggaactgctgggagctctatggcccaggcccaccccagcttacttgctgaccttggcctcgcctttcctgactttcagtctccctataaaattggagatcccacagagatctcagacccccctgcagcccctggtcagcccaggggaacagaccccatgtttctttccagcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctcnttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcaaaaaaaaaaaactt

SEQ ID NO: 372615 - DNA, 2339 bp, Homo sapiens
  misc_feature (1693)..(1693): n is a, c, g, or t
tgcttattaattacattttaaaatgaagggttacaaaaagagatgagcctggcatttctaattcgggggccttgggacctctcccctccaagtgcaagttgtagcaacctgccgggtccacgcatgggcgggtcatactccacgggttccggtttccactccctgtgaaccaaaagccagagaggcccacgcacgagtccggaagtgagggagggaggactttcgtacgcagccgcctcccagctggaacctcatctttagtgctcggccgcgggcggcgtaactcggggttccgcctcggaatacctcccacttctcttgtctaagaggagcagtagcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatanacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacaggaggacgggcagggtgcgggcagcagaattccacatggtgctgggctgtcggggaggcctcaggccacctccaggaacagaacacagttttaagtttgattttttttatttcaaaatgctttgcaattaaatgaattactgttcaaaaaaaaaaaactt

SEQ ID NO: 372616 - DNA, 1610 bp, Homo sapiens
tgcttattaattacattttaaaatgaagggttacaaaaagagatgagcctggcatttctaattcgggggccttgggacctctcccctccaagtgcaagttgtagcaacctgccgggtccacgcatgggcgggtcatactccacgggttccggtttccactccctgtgaaccaaaagccagagaggcccacgcacgagtccggaagtgagggagggaggactttcgtacgcagccgcctcccagctggaacctcatctttagtgctcggccgcgggcggcgtaactcggggttccgcctcggaatacctcccacttctcttgtctaagaggagcagtagcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatggtgagaaaaagaagtccatgtctgaagaagatgcccacatttactttgcagaaggtcataggaaggacaaacacattgtctcagagagagaggaactctaggccaaaggaagatttgtttgattctctttcatatttttcagaaagtgtgatctctgagtgggcacctgtatgattgatccctatggttttctccatatggcatggtttgagcccttaaaactcatttaatcagaatttgtgtgaactggctgttcctggcctgctggttcagtgggctggctgtgactctcctgtggcacctggggctgccatctatcttgctgcgtccgtagcgc

SEQ ID NO: 372617 - DNA, 522 bp, Homo sapiens
agcctacagacagcttctgggctggaccacgtcctgacatccattccttttgccttagtcattatttgtggcctgtaaattctttcctggcttctgtgcctctctcctacttgatttattctgttctctccttcctgtcctgcctcaggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagtgagtggccagttctgccttacaagcctttccatcacaggccagctttgcttgttctagcagcaccatgagctccaagtgcctgtctggaggactgcattaccccagactctggttgtaagttctggaagttcaacctaaaagagtcttaagtaaaactaggttggccgggcacagtggctcacgcctgtaatc

SEQ ID NO: 372618 - DNA, 426 bp, Homo sapiens
tgataaatgaagtttaaaacttctaggtttagcaattctgggaagatactaaaagtaataattatatagaaccaactcaagaatgcatgttgcaattcctcaggtaaacactaaaagaacagtaaaagaaagtgtagttagcatgttactacaaataaataaatggatgtttgattaatgcagagaaaagttatgagaaaaaaagaatatagtaaacagggcaactaggtaggaaatagaggaaaacatagcagaaaaatctttgtaaccctggagtaggcaaggatttcttttttttcttttctttcttttttttttgagatggggtcttgctctgttgccaggctggagtgcagtggcgtgacctcagctccctgcaacctccgcctcccgggttcaagcgattcccctgcctcagcctcccaa

SEQ ID NO: 372619 - DNA, 261 bp, Homo sapiens
ccatgtgagccatatggctgtgttgcaattactccactctgccattgtagtgcaaaagctaccatagatgatacataaagaaaagagatggactgtgttgaaacataactttatttacaaaggcagcagccagacctaatttggctgttaggctgtaattgacccctagactagaggctggtggcagtttgggcagataggcaatagtaaggacttgaatggaaaagcaaggcccagcataaggaagatgtggattcagag

SEQ ID NO: 372620 - DNA, 677 bp, Homo sapiens
tgaaagaattatgcttttgaattgtggaagaattatttctgcttaagtttagaaatgagccagaagcggccaggcgtggtggctcacgcctgtaatctcagcactttcggaagccgaggtgggtggatcacctgagatcaggagatcgagaccatcgtggccaacacggtaaaaccctgtctctactaaaaatacaaaaattagctgggtgtggtggcatgtacctgtagtcccagctacttggaaggctgaggcaggagaatcatttgaactttgggaggcggaggttgcagtttgcttgagattcgcatcactgcactccagcctagtgacagagttgagattttgtctgtctcaaaaaaaaaaaaaaaaagaaagaaagaaatgagccagaagctttatgaaactgtacttgcctctgtttgaaaactgaaaggacaaacatgaattagtttttgatacttttggaatacatgtgagaccacattattctctattcaggttaagcaatgataagcgtgccctccattttaaatgctttctcttttataaatagagcctggtagtgcagcctttaaatgcaggtggtacaggtgtaaaatagttctgtaagtaactttccatgtctaaaagtgtcttaaacagctactgtgacattgatggagccatcgaaatat

SEQ ID NO: 372621 - DNA, 218 bp, Homo sapiens
aagttgcaaggaagaagatagtagtagggggagcagtgggatggctctgccaaatgactcagctgctagtgagggcctctgaaataaagttattggttcttactgctttgaagagtaaagtttgctttgataccctacccttcattgtttgagagttgaaaaagattgtttgaaactactgaaataatatccacataaaatatccacgttagtaagga

SEQ ID NO: 372622 - DNA, 1706 bp, Homo sapiens
gcgcggggggcggacccgccagctgcctgcgctgctcgccagcttgctcgcactcggctgtgcggcggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaa

SEQ ID NO: 372623 - DNA, 732 bp, Homo sapiens
ttttcactctggatacatgaggaggactgaccatgtactgtacttcttttaacttctatagagcaatctctttgtatttatacaattatgacaacagtagtaagagaagaaggttcagaggatacaagcatgctgcagtacaaaaattctataaaaataccttttttgagtcattaacataaaatgaagaaaacagcagcagccaagaagagagatgttgaaatttaagagaggaagacagagaagaaaaatccactggataccttatgtgtaattcaccaatctgttggaacacttctgccacgtgtgaagagttttggcagaccaaatccacatgcctgaagtgatgcccaccaacaaagacataaaaattttcaacatttcaacagccatgttggaatcatctgcagaataccgaaaaagtgcccagttggagatttcataaaaataacaggcaatcacacacgttgcaggaactgtgtacagtactgagaacaccccaatcttgaccatcagtctttctaacttgtctgtctttgtcccatccttttgaagatttgaccgaattttgaacaaggccaccaaacctgcagcaatgaacaaagttccaatgaccaaataagtaaagaggggagccaccacgaacccggtgagggcatcgagattttggtttccaacatagcacaagccagtcagttcatctgcatccaccagtctcataatcaagatgac

SEQ ID NO: 372624 - DNA, 3774 bp, Homo sapiens
gcgcggggggcggacccgccagctgcctgcgctgctcgccagcttgctcgcactcggctgtgcggcggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaatgaattcttatatgtgtgcatgtgtgttttcttctgagattcatcttggtggtgggtttttttgtttttttaattcagtgcctgatctttaatgcttccataaggcagtgttcccatttaggaactttgacagcatttgttaggcagaatattttggatttggaggcatttgcatggtagtctttgaacagtaaaatgatgtgttgactatactgatacacatattaaactataccttatagtaaaccagtatcccaagctgcttttagttccaaaaatagtttcttttccaaaggttgttgctctactttgtaggaagtctttgcatatggccctcccaactttaaagtcataccagagtggccaagagtgtttatcccaacccttccatttaacaggatttcactcacatttctggaactagctatttttcagaagacaataatcagggcttaattagaacaggctgtatttcctcccagcaaacagttgtggccacactaaaaacaatcatagcattttacccctggattatagcacatctcatgttttatcatttggatggagtaatttaaaatgaattaaattccagagaacaatggaagcattgcctggcagatgtcacaacagaataaccacttgtttggagcctggcacagtcctccagcctgatcaaaaattattctgcatagttttcagtgtgctttctgggagctatgtacttcttcaatttggaaacttttctctctcatttatagtgaaaatacttggaagttactttaagaaaaccagtgtggcctttttccctctagctttaaaagggccgcttttgctggaatgctctaggttatagataaacaattaggtataatagcaaaaatgaaaattggaagaatgcaaaatggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaaaatcaaatggactacaagcacgtgtttgctgtgcttgcaccccaggtaaacctgcattgtagcaatttgtaaggatattcagatggagcactgtcacttagacattctctgggggattttctgcttgtctttcttgagctttttggaaggataattctgataaggcactcaagaaacgtacaaccacagtgctttcttcaaatcatatgagaaatactatgcatagcaaggagatgcagagccgccaggaaaattctgagttccagcacaattttctttggaatctaacaggaatctagcctgaggaagaagggaggtctccatttctatgtctggtatttgggggttttgtttgtttttgctttagcttggtgaaaaaaagttcactgaacaccaagaccagaatggatttttttaaaaaaatagatgttccttttgtgaagcaccttgattccttgattttgattttttgcaaagttagacaatggcacaaagtcaaaatgaaatcaatgtttagttcacaagtagatgtaatttactaaagaatgatacacccatatgctatatacagcttaactcacagaactgtaaaagaaaattataaaataattcaacatgtccatctttttagtgataataaaagaaagcatggtattaaactatcatagaagtagacagaaaaagaaaaaaggactcatggcattattaatataattagtgctttacatgtgttagttatacatattagaagcatatttgcctagtaaggctagtagaaccacatttcccaaagtgtgctccttaaacactcatgccttatgattttctaccaaaagtaaaaagggttgtattaagtcagaggaagatgcctctccattttccctctctttatcagaggttcacatgcctgtctgcacattaaaagctctgggaagacctgttgtaaagggacaagttgaggttgtaaaatctgcatttaaataaacatctttgatcacaaaaaaaaaaat

SEQ ID NO: 372625 - DNA, 2249 bp, Homo sapiens
gcgcggggggcggacccgccagctgcctgcgctgctcgccagcttgctcgcactcggctgtgcggcggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaaaaaaaaaaaaaaaaaaaaaaaaaaaaaaaaaaaaaaaaaaaaaaaaaaaaaaaaaaaaaaaaaaaaaaaaaaaaaaaaaaaaagggggggcgcgcgcccgccaaaaaccccccggggggcgccccccaccccccccccttttgaaggggccccccggggaggctgaatattataataagcagcgacgaaagcgggggggcggcgcgtaataataaaacaacaagcgcgcgagagaggagagcgaaaaaacacgcgctgccacgggggagaacgtactgtggggaaagaggaccacccccctcttccgtgggggcgggaggggacaaccaataggatgtgggggagacaacacccacaccacaccagcaaagagataatattatgagcctccagggcagagacaaataatacaaaccctgaaggggatagaacaacaaggtcggtaaccaccaccaccgtacatataacatcggcgcgcgaaagaaaaaattggtggcacagggacagaatcatgcctgagaaacaaatatactacgcgggacg

SEQ ID NO: 372626 - DNA, 1600 bp, Homo sapiens
tcgtttgcgtggccacttcgtaagtgggcagtggagttcccttatgacactggggtccacatgaagaagatacttctaatttggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaa

SEQ ID NO: 372627 - DNA, 1962 bp, Homo sapiens
gcgcggggggcggacccgccagctgcctgcgctgctcgccagcttgctcgcactcggctgtgcggcggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactggggagcaagactccagtcttctcccatcagtaataaaaaattaaaaacttttgttgactctgtgtgaacacaatagactaggaactcttccctagacagtgttagaattggcaagaaatgtcaccagcaacttttaagaactttccggtggtccacaccttccgctcggccaaatcatcttcagagaggaggctcaaatcaggccctgtcctgacccccaggcgcagatctgggggaccacctccaagacaccctgtttcttgccaatccgggtcaacttcccgacagtctctcgcgggcaggagcaaagggacttagcagtcactcttccacagtttaattgttttgtcattttctagcgcagcagaggcgatgatgtttt

SEQ ID NO: 372628 - DNA, 1087 bp, Homo sapiens
gcgcggggggcggacccgccagctgcctgcgctgctcgccagcttgctcgcactcggctgtgcggcggggcaggcatgggagccgcgcgctctctcccggcgcccacacctgtctgagcggcgcagcgagccgcggcccgggcgggctgctcggcgcggatggctccctaatgagtagaatgagacctgtgtgccaaccctggcctagtcctcatgcccccacaactgtgaagcgagagggctcaacagtttcgaattcaattcaaccaccacctcctgaataccaactaggttccaggacctggctagaagcagagacaccaggacagaaaagacagtgttctgctttcatggagttcacagaagagtcgaggagagcttcacatttttcatccattcttaaaattgagccagtttagccctaggaggtgggcaggctctgaggaatcatcaatcaagagaagagaacatcgccagaaacaccatgctgcagtacaaaaattctataaaaataccttttttgagtcattaacataaaatgaagaaaacagcagcagccaagaagagagatgttgaaatttaagagaggaagacagagaagaaaaatccactggataccttatgtgtaattcaccaatctgttggaacacttctgccacgtgtgaagagttttggcagaccaaatccacatgcctgaagtgatgcccaccaacaaagacataaaaattttcaacatttcaacagccatgttggaatcatctgcagaataccgaaaaagtgcccagttggagatttcataaaaataacaggcaatcacacacgttgcaggaactgtgtacagtactgagaacaccccaatcttgaccatcagtctttctaacttgtctgtctttgtcccatccttttgaagatttgaccgaattttgaacaaggccaccaaacctgcagcaatgaacaaagttccaatgaccaaataagtaaagaggggagccaccacgaacccggtgagggcatcgagattttggtttccaacatagcacaagccagtcagttcatctgcatccaccagtctcataatcaagatgac

SEQ ID NO: 372629 - DNA, 2209 bp, Homo sapiens
gcgcggggggcggacccgccagctgcctgcgctgctcgccagcttgctcgcactcggctgtgcggcggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaaaaaaaaaaaaaaaaaaaaaaaaaaaaaaaaaaaaaaaaaaaaagggggggcgcgcgcccgccaaaaaccccccggggggcgccccccaccccccccccttttgaaggggccccccggggaggctgaatattataataagcagcgacgaaagcgggggggcggcgcgtaataataaaacaacaagcgcgcgagagaggagagcgaaaaaacacgcgctgccacgggggagaacgtactgtggggaaagaggaccacccccctcttccgtgggggcgggaggggacaaccaataggatgtgggggagacaacacccacaccacaccagcaaagagataatattatgagcctccagggcagagacaaataatacaaaccctgaaggggatagaacaacaaggtcggtaaccaccaccaccgtacatataacatcggcgcgcgaaagaaaaaattggtggcacagggacagaatcatgcctgagaaacaaatatactacgcgggacg

SEQ ID NO: 372630 - DNA, 1570 bp, Homo sapiens
gcggccgcgagctcgcggagctgaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaa

SEQ ID NO: 372631 - DNA, 1663 bp, Homo sapiens
gcgcggggggcggacccgccagctgcctgcgctgctcgccagcttgctcgcactcggctgtgcggcggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactggggagcaaatggcgcatcttctcccatcagcaattcctgcagagggttaaaaattacactggtttatactactgatgggacga

SEQ ID NO: 372632 - DNA, 1775 bp, Homo sapiens
gcgcggggggcggacccgccagctgcctgcgctgctcgccagcttgctcgcactcggctgtgcggcggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactggcagtcttctcccatcagccatcttcgtccctcaggttcactttgtatcaagtatttttactttttatttttcatttaggatattttctattgttgtcttcaggcccactgatcattacttctatagctactgctctgatataaccccgtctattaaaaatttaagtacctgatggacgcaaggttcggtccggc

SEQ ID NO: 372633 - DNA, 1840 bp, Homo sapiens
tgcaccaggatggctctgaaatggacttcagttcttctgctgatacatctcagttgttactttagctctgggagttgtggaaaggtgctggtgtgggccgcagaatacagccattggatgaatatgaagacaatcctgaaagagcttgttcagagaggtcatgaggtgactgtactggcatcttcagcttccattctttttgatcccaatgacgcatccactcttaaactcgaagtttatcctacatctttaactaaaactgaatttgagaatatcatcatgcaacaggttaagagatggtcagacattcgaaaagatagcttttggttatatttttcacaagaacaagaaatcctgtgggaattatatgacatatttagaaacttctgtaaagatgtagtttcaaataagaaagttatgaaaaaactacaagagtcaagatttgacatcgtttttgcagatgctgtttttccctgtggtgagctgctggctgcgctacttaacatacggtttgtgtacagtctccgctttactcctggctacacaattgaaaggcacagtggaggactgattttccctccttcctacatacctattgttatgtcaaaattaagtgatcaaatgactttcatggagagggtaaaaaatatgatctatgtgctttattttgacttttggttccaaatgtctgatatgaagaagtgggatcagttttacagtgaagttttaggaagacccactaccttatttgagacaatggggaaagctgacatatggcttatgcgaaactcctggagttttcaatttcctcatccattcttaccaaacgttgattttgttggaggattccactgcaaacctgccaaacccctacctaaggaaatggaggagtttgtacagagctctggagaaaatggtgttgtggtgttttctctggggtcagtgataagtaacatgacagcagaaagggccaacgtaattgcaacagcccttgccaagatcccacaaaaggttctgtggagatttgatgggaataaaccagatgccttaggtctcaatactcggctgtacaagtggataccccagaatgaccttctaggtcatccaaaaaccagagcttttataactcatggtggagccaatggcatctatgaggcaatctaccatgggatccctatggtgggcattccattgttttgggatcaacctgataacattgctcacatgaaggccaagggagcagctgttagactggacttccacacaatgtcgagtacagacctgctgaatgcactgaagacagtaattaatgatcctttatataaagagaatgttatgaaattatcaagaattcaacatgatcaaccagtaaagcccctggatcgagcagtcttctggattgaatttgtcatgcgccacaaaggagccaaacaccttcgagttgcagcccgtgacctcacctggttccagtaccactctttggatgtgattgggtttctgctggcctgtgtggcaactgtgatatttatcatcacaaagttttgtctgttttgtttctggaagtttgctagaaaagggaagaagggaaaaagagattagttatgtctgacatttgaagctggaaaaccagatagatgggatgacttcagtttattccagcaagaaagaaaagattgttatgcaagatttctttcttcctgtgacaaaaaaaaaaacttttcaaaatctaccttgtcaagtaaaaatttgtttttcagagatttaccacccaagtaatggttagaaatattctgtggcaatgaagaaaacactagggaaaataaaaaataatataaagcca

SEQ ID NO: 372634 - DNA, 1489 bp, Homo sapiens
tgcaccaggatggctctgaaatggacttcagttcttctgctgatacatctcagttgttactttagctctgggagttgtggaaaggtgctggtgtgggccgcagaatacagccattggatgaatatgaagacaatcctgaaagagcttgttcagagaggtcatgaggtgactgtactggcatcttcagcttccattctttttgatcccaatgacgcatccactcttaaactcgaagtttatcctacatctttaactaaaactgaatttgagaatatcatcatgcaacaggttaagagatggtcagacattcgaaaagataacttttggttccaaatgtctgatatgaagaagtgggatcagttttacagtgaagttttaggaagacccactaccttatttgagacaatggggaaagctgacatatggcttatgcgaaactcctggagttttcaatttcctcatccattcttaccaaacgttgattttgttggaggattccactgcaaacctgccaaacccctacctaaggaaatggaggagtttgtacagagctctggagaaaatggtgttgtggtgttttctctggggtcagtgataagtaacatgacagcagaaagggccaacgtaattgcaacagcccttgccaagatcccacaaaaggttctgtggagatttgatgggaataaaccagatgccttaggtctcaatactcggctgtacaagtggataccccagaatgaccttctaggtcatccaaaaaccagagcttttataactcatggtggagccaatggcatctatgaggcaatctaccatgggatccctatggtgggcattccattgttttgggatcaacctgataacattgctcacatgaaggccaagggagcagctgttagactggacttccacacaatgtcgagtacagacctgctgaatgcactgaagacagtaattaatgatcctttatataaagagaatgttatgaaattatcaagaattcaacatgatcaaccagtaaagcccctggatcgagcagtcttctggattgaatttgtcatgcgccacaaaggagccaaacaccttcgagttgcagcccgtgacctcacctggttccagtaccactctttggatgtgattgggtttctgctggcctgtgtggcaactgtgatatttatcatcacaaagttttgtctgttttgtttctggaagtttgctagaaaagggaagaagggaaaaagagattagttatgtctgacatttgaagctggaaaaccagatagatgggatgacttcagtttattccagcaagaaagaaaagattgttatgcaagatttctttcttcctgtgacaaaaaaaaaaacttttcaaaatctaccttgtcaagtaaaaatttgtttttcagagatttaccacccaagtaatggttagaaatattctgtggcaatgaagaaaacactagggaaaataaaaaataatataaagcca

SEQ ID NO: 372635 - DNA, 1653 bp, Homo sapiens
tgcaccaggatggctctgaaatggacttcagttcttctgctgatacatctcagttgttactttagctctgggagttgtggaaaggtgctggtgtgggccgcagaatacagccattggatgaatatgaagacaatcctgaaagagcttgttcagagaggtcatgaggtgactgtactggcatcttcagcttccattctttttgatcccaatgacgcatccactcttaaactcgaagtttatcctacatctttaactaaaactgaatttgagaatatcatcatgcaacaggttaagagatggtcagacattcgaaaagatagcttttggttatatttttcacaagaacaagaaatcctgtgggaattatatgacatatttagaaacttctgtaaagatgtagtttcaaataagaaagttatgaaaaaactacaagagtcaagatttgacatcgtttttgcagatgctgtttttccctgtggtgagctgctggctgcgctacttaacatacggtttgtgtacagtctccgctttactcctggctacacaattgaaaggcacagtggaggactgattttccctccttcctacatacctattgttatgtcaaaattaagtgatcaaatgactttcatggagagggtaaaaaatatgatctatgtgctttattttgacttttggttccaaatgtctgatatgaagaagtgggatcagttttacagtgaagttttaggaagacccactaccttatttgagacaatggggaaagctgacatatggcttatgcgaaactcctggagttttcaatttcctcatccattcttaccaaacgttgattttgttggaggattccactgcaaacctgccaaacccctacctaaggaaatggaggagtttgtacagagctctggagaaaatggtgttgtggtgttttctctggggtcagtgataagtaacatgacagcagaaagggccaacgtaattgcaacagcccttgccaagatcccacaaaaggttctgtggagatttgatgggaataaaccagatgccttaggtctcaatactcggctgtacaagtggataccccagaatgaccttctaggtcatccaaaaaccagagcttttataactcatggtggagccaatggcatctatgaggcaatctaccatgggatccctatggtgggcattccattgttttgggatcaacctgataacattgctcacatgaaggccaagggagcagctgttagactggacttccacacaatgtcgagtacagacctgctgaatgcactgaagacagtaattaatgatcctttgtgagtagaacaatgtttttcactaggaggtatttgtagacagcttctcttgtcaatagtgagcatgagtttcatcctttttatgagagtaattttgaaagaatttaaataatttaaccaatctgaaatctgctttttttcatctgttatttaaaaattgtatttgaaccccatacatctaatgagtaaccagttagtgaaacaattttctaaacaaaaataattttaaaatgataaataatataaaaaatacatttcttaaaattttaacataatgaacccatagtagaaaggaagaataaacttgaaataatataataaaatgttttaatta

SEQ ID NO: 372636 - DNA, 802 bp, Homo sapiens
tgcaccaggatggctctgaaatggacttcagttcttctgctgatacatctcagttgttactttagctctgggagttgtggaaaggtgctggtgtgggccgcagaatacagccattggatgaatatgaagacaatcctgaaagagcttgttcagagaggtcatgaggtgactgtactggcatcttcagcttccattctttttgatcccaatgacgcatccactcttaaactcgaagtttatcctacatctttaactaaaactgaatttgagaatatcatcatgcaacaggttaagagatggtcagacattcgaaaagatagcttttggttatatttttcacaagaacaagaaatcctgtgggaattatatgacatatttagaaacttctgtaaagatgtagtttcaaataagaaagttatgaaaaaactacaagagtcaagatttgacatcgtttttgcagatgctgtttttccctgtggtgagctgctggctgcgctacttaacatacggtttgtgtacagtctccgctttactcctggctacacaattgaaaggcacagtggaggactgattttccctccttcctacatacctattgttatgtcaaaattaagtgatcaaatgactttcatggagagggtaaaaaatatgatctatgtgctttattttgacttttggttccaaatgtctgatatgaagaagtgggatcagttttacagtgaagttttaggtaagaatttgtttaatcggtaacgtgaagatctaacttatttgtgtctttgaagcagagcttatataaagc

SEQ ID NO: 372637 - DNA, 2708 bp, Homo sapiens
ttctgtggatcaggggccgagctccgcccccggcgcgcggctgagtccctctctataaaaggagccggcggaggatgacgagcggctttacgtcggcgcgtaacgagggggtgcgtgtgaggtcatcgcgcgggcgggcgggcggggtctggcggtttgaacgagacgaagacggaaccggagccggttgcgggcagtggacgcggttctgccgagagccgaagatggcagtgaacgtatactcaacgtcagtgaccagtgataacctaagtcgacatgacatgctggcctggatcaatgagtctctgcagttgaatctgacaaagatcgaacagttgtgctcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaaataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcagctccccagaggcccatctcaacacagagaaccgctgcggctcctaaggctggccctggtgtggtgcgaaagaaccctggtgtgggcaacggagacgacgaggcagctgagttgatgcagcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacatctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagta

SEQ ID NO: 372638 - DNA, 2572 bp, Homo sapiens
ttctgggccgccgctgaggtgtggtccctgcgctgcagcgactggaggtcccagggtggttgggccctgggagggtgtgggcgagaagatggcagtgaacgtatactcaacgtcagtgaccagtgataacctaagtcgacatgacatgctggcctggatcaatgagtctctgcagttgaatctgacaaagatcgaacagttgtgctcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaaataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcagctccccagaggcccatctcaacacagagaaccgctgcggctcctaaggctggccctggtgtggtgcgaaagaaccctggtgtgggcaacggagacgacgaggcagctgagttgatgcagcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacatctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagta

SEQ ID NO: 372639 - DNA, 2387 bp, Homo sapiens
aacttaggctaggtacgaggctgggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaaataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcagctccccagaggcccatctcaacacagagaaccgctgcggctcctaaggctggccctggtgtggtgcgaaagaaccctggtgtgggcaacggagacgacgaggcagctgagttgatgcagcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacatctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagta

SEQ ID NO: 372640 - DNA, 2528 bp, Homo sapiens
ttctgtggatcaggggccgagctccgcccccggcgcgcggctgagtccctctctataaaaggagccggcggaggatgacgagcggctttacgtcggcgcgtaacgagggggtgcgtgtgaggtcatcgcgcgggcgggcgggcggggtctggcggtttgaacgagacgaagacggaaccggagccggttgcgggcagtggacgcggttctgccgagagccgaagatggcagtgaacgtatactcaacgtcagtgaccagtgataacctaagtcgacatgacatgctggcctggatcaatgagtctctgcagttgaatctgacaaagatcgaacagttgtgctcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaaataattcctgtggacaaattagtaaaaggaaagtttcaggacaattttgaattcgttcagtggttcaagaagtttttcgatgcaaactatgatggaaaagaccctggtgtgggcaacggagacgacgaggcagctgagttgatgcagcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacatctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagta

SEQ ID NO: 372641 - DNA, 1931 bp, Homo sapiens
agttgattttagtccaaagcagtgctgtccaatgaaggtagaaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacatctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagta

SEQ ID NO: 372642 - DNA, 2346 bp, Homo sapiens
tagtgacggggatctcactttattgcccaggctggagtgcctggtggtgcgatcatggctcactgcagctttgacctcctgggtcaagcagtcctgcctcgaccccgctggggagtagctgggactacaggcatgtcccaccaggcttggctagtttttttttttttcgagacattgtctcactgtgttacccaggctggtcttgaacttctgggctcaagccttggccttccaaagtgctaggattacaggcatgagccatcacacctggccttctttcttctttaaaaaacagttttattgaagtataactgacataataaactgcacatatttaaaatgtacctttgatgacatgggtgaaattaccaccataatgaagacaatgtaaatatgcatcactttcaaaagtttgagggtaaatttgactgtgctcagtttttgtctttggtgagatgcaattctactacccaagaaataaaatagcagtcacctggcctgtatagagccaggaagaaccattgtttttaagaggctgtaagtatgaggaaagtgaactcacagtagaaatggatctttcagtggctttcccctctcattttcctatttcaggaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacatctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagta

SEQ ID NO: 372643 - DNA, 1616 bp, Homo sapiens
aacttaggctaggtacgaggctggaggactcactggtttcttttcataagcaaaaagtacctcttcttaaagtgcactttgcagacgtttcactccttttccaataagtttgagttaggagcttttaccttgtagcagagcagtattaacatctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagta

SEQ ID NO: 372644 - DNA, 2182 bp, Homo sapiens
ttctgtggatcaggggccgagctccgcccccggcgcgcggctgagtccctctctataaaaggagccggcggaggatgacgagcggctttacgtcggcgcgtaacgagggggtgcgtgtgaggtcatcgcgcgggcgggcgggcggggtctggcggtttgaacgagacgaagacggaaccggagccggttgcgggcagtggacgcggttctgccgagagccgaagatggcagtgaacgtatactcaacgtcagtgaccagtgataacctaagtcgacatgacatgctggcctggatcaatgagtctctgcagttgaatctgacaaagatcgaacagttgtgctcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaaataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcagctccccagaggcccatctcaacacagagaaccgctgcggctcctaaggctggccctggtgtggtgcgaaagaaccctggtgtgggcaacggagacgacgaggcagctgagttgatgcagcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacatctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccacactggcaaagtattcggattacagtggagagctgtgaacagcagataccgaaaacaccccagcctggaagatcccaaggtaa

SEQ ID NO: 372645 - DNA, 692 bp, Homo sapiens
ttctgtggatcaggggccgagctccgcccccggcgcgcggctgagtccctctctataaaaggagccggcggaggatgacgagcggctttacgtcggcgcgtaacgagggggtgcgtgtgaggtcatcgcgcgggcgggcgggcggggtctggcggtttgaacgagacgaagacggaaccggagccggttgcgggcagtggacgcggttctgccgagagccgaagatggcagtgaacgtatactcaacgtcagtgaccagtgataacctaagtcgacatgacatgctggcctggatcaatgagtctctgcagttgaatctgacaaagatcgaacagttgtgctcaggggctgcgtattgtcagtttatggacatgctgttccctggctccattgccttgaagaaactgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagta

SEQ ID NO: 372646 - DNA, 1274 bp, Homo sapiens
ttctgtggatcaggggccgagctccgcccccggcgcgcggctgagtccctctctataaaaggagccggcggaggatgacgagcggctttacgtcggcgcgtaacgagggggtgcgtgtgaggtcatcgcgcgggcgggcgggcggggtctggcggtttgaacgagacgaagacggaaccggagccggttgcgggcagtggacgcggttctgccgagagccgaagatggcagtgaacgtatactcaacgtcagtgaccagtgataacctaagtcgacatgacatgctggcctggatcaatgagtctctgcagttgaatctgacaaagatcgaacagttgtgctcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaagtaagtaaacgttatcttttattgtggttaatgttccttaatgatcgttgctaaggaggtagatgctagcttatgactttggacattttcttttttttcttaatttatctagttaacttttctcagttaacacagaatttactgggagcagtttgcccctaccttcttgcccctattccccttgcttgtttctttcttcatcgtctgtgaagttagtaactgtttagaggagtcagcctgtaaatttgtacagtgatttttatttttaaaaaattcctgtgtaatctctagtagtctggaatctaactctcttaatctggatttacttctgtaaaagcatactgtatgtagaatagttccagtagagaagattctaggccaggcgtggtggctcacacccgtaatcccagcactttggaggctgaggtggagaagattctagaaatacttgctttttatagaaggttacaaggaggctccgtggtgggtgctggaaaactcctttctgcccccaaaggtttttgaaggtaacagaaacatggtccaccaggcatggtttagcacaaacatttaatgtttagcacaaatattacctctgttttagtagataatagattaagtagtttatcccttcccccacccttgtgaagggtttatccttttaagccatttttggggggataactttttttttttatggcaaaggtagtaacacccccaattatcttgctggtgtctggtttttatttattttgaaatcagggtttttttttaattttagtt

SEQ ID NO: 372647 - DNA, 240 bp, Homo sapiens
ctactttaaacagtttctaaataaaattctgtatttcaagagtatcatgtcttctgaaatttgtcttgccctgggtatatgctgttaggttcaagtgatgggaaaccagtgcttctttcttcagtgaggactgatcttttcacatcctttactgatttttcagatgtgcttatttcttcttcttcttcttttttttttttttttttttgagatggagtcttggtctgtcgcccaggctgg

SEQ ID NO: 372648 - DNA, 588 bp, Homo sapiens
agaaattgacttcacatgaagttagtgaagcttttggtttttgtaggtctacttcacaattttaaaaattgtatttggtttaagtgggtctgggaagaagttcaccctgcttctttaattgtatttttctgttgccgttgttctttcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaagtaagtaaacgttatcttttattgtggttaatgttccttaatgatcgttgctaaggaggtagatgctagcttatgactttggacattttcttttttttcttaatttatctagttaacttttctcagttaacacagaatttactgggagcagtttgcccctaccttcttgcccctattccccttgcttgtttctttcttcatcgtctgtgaagttagtaactgtttagaggagtcagcctgtaaatttgtacagtgatttttatttttaaaaaattcctgtgtaatctctagta

SEQ ID NO: 372649 - DNA, 2597 bp, Homo sapiens
ttctgtggatcaggggccgagctccgcccccggcgcgcggctgagtccctctctataaaaggagccggcggaggatgacgagcggctttacgtcggcgcgtaacgaggggaagatggcagtgaacgtatactcaacgtcagtgaccagtgataacctaagtcgacatgacatgctggcctggatcaatgagtctctgcagttgaatctgacaaagatcgaacagttgtgctcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaaataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcagctccccagaggcccatctcaacacagagaaccgctgcggctcctaaggctggccctggtgtggtgcgaaagaaccctggtgtgggcaacggagacgacgaggcagctgagttgatgcagcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacatctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagta

SEQ ID NO: 372650 - DNA, 2661 bp, Homo sapiens
ttctgtggatcaggggccgagctccgcccccggcgcgcggctgagtccctctctataaaaggagccggcggaggatgacgagcggctttacgtcggcgcgtaacgagggggtgcgtgtgaggtcatcgcgcgggcgggcgggcggggtctggcggtttgaacgagacgaagacggaaccggagccggttgcgggcagtggacgcggttctgccgagagccgaagatggcagtgaacgtatactcaacgtcagtgaccagtgataacctaagtcgacatgacatgctggcctggatcaatgagtctctgcagttgaatctgacaaagatcgaacagttgtgctcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaaataattcctgtggacaaattagtaaaaggaaagtttcaggacaattttgaattcgttcagtggttcaagaagtttttcgatgcaaactatgatggaaaagacttcccttgttgctccagctctgaataaaccgaagaaacctctcacttctagcagtgcagctccccagaggcccatctcaacacagagaaccgctgcggctcctaaggctggccctggtgtggtgcgaaagaaccctggtgtgggcaacggagacgacgaggcagctgagttgatgcagcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacatctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagta

SEQ ID NO: 372651 - DNA, 2783 bp, Homo sapiens
ttctgtggatcaggggccgagctccgcccccggcgcgcggctgagtccctctctataaaaggagccggcggaggatgacgagcggctttacgtcggcgcgtaacgagggggtgcgtgtgaggtcatcgcgcgggcgggcgggcggggtctggcggtttgaacgagacgaagacggaaccggagccggttgcgggcagtggacgcggttctgccgagagccgaagatggcagtgaacgtatactcaacgtcagtgaccagtgataacctaagtcgacatgacatgctggcctggatcaatgagtctctgcagttgaatctgacaaagatcgaacagttgtgctcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaaataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcagctccccagaggcccatctcaacacagagaaccgctgcggctcctaaggctggccctggtgtggtgcgaaagaaccctggtgtgggcaacggagacgacgaggcagctgagttgatgcagcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacatctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatacttgctttctacacacatttcaggacaagctaccaccagaaacaaatcaatacaaatacatcaggggctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagta

SEQ ID NO: 372652 - DNA, 1974 bp, Homo sapiens
ttctgtggatcaggggccgagctccgcccccggcgcgcggctgagtccctctctataaaaggagccggcggaggatgacgagcggctttacgtcggcgcgtaacgagggggtgcgtgtgaggtcatcgcgcgggcgggcgggcggggtctggcggtttgaacgagacgaagacggaaccggagccggttgcgggcagtggacgcggttctgccgagagccgaagatggcagtgaacgtatactcaacgtcagtgaccagtgataacctaagtcgacatgacatgctggcctggatcaatgagtctctgcagttgaatctgacaaagatcgaacagttgtgctcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaaataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcagctccccagaggcccatctcaacacagagaaccgctgcggctcctaaggctggccctggtgtggtgcgaaagaaccctggtgtgggcaacggagacgacgaggcagctgagttgatgcagcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacatctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggaccttgacactgctgaatgttttgtcctccccctttaatattttctaggtacttgcctgcgagcttcctgaactcatttttaccccctgaactctgg

SEQ ID NO: 372653 - DNA, 1988 bp, Homo sapiens
ggcacgaggctccatgtgatcacatggagtatgctgtgaactgccatgtgatcacctgggagaggattatcagccactttgatatttttgcatttggacatttctggggctgggccatgaaggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttggggtcattggtttcctggaggccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaggtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagctaggtgccttttacatcgggtttgttctccttccatggtgtgttgctgacattgtcactgagtcccatgtgaggtgctggtgagtattacctttcatctgtgccatgctctagaaccttgaccttgatagttcaccacctctgatggatccctgttttaaataaaaacgattcactttaaagccta

SEQ ID NO: 372654 - DNA, 111 bp, Homo sapiens
aattcaagcttctaacgatgtacggggacatgctctagaaccttgaccttgatagttcaccacctctgatggatccctgttttaaataaaaacgattcactttaaagccta

SEQ ID NO: 372655 - DNA, 3243 bp, Homo sapiens
cagagccccctcctgaggcttctcacactgcgctaattagccagcatggttgagttttcactacatcagccagggaaaaacacaaaacaaaaccaatcaccctctactgggccgcgaaaacctaaaggcccttgaggccctggggcgcggtctggacgcgggtgcgccggaacctgaaccctcgccaggagcgcgatcctcgtgctggggcagctcctgctttacctgtggcgaggcctgcttcccgtagcgggtgaccccgggaccgaccaactcgctgggccgcacgtcccgtcccgccgcgccgcacgccggctcctcagcccgccctacacagcgcagccgcgctcccgggcccacgtgggccgcgcccggagtgggcgagaccatgtgccgggttacgcggggagacagcgggctacgtgctctgaaaagagccagccaggggccccggctacccttctccggctcgctattcctctgaagtcctgtggacttggagtctgaaaattcctcgagtggtagagatgcctcagctaggatgacagcgtggggacggccggcggcgtcccctgccccaggccgcggtggcggcgccgcgaccccgccctctcgcgcctgtccttccctctgctcccagcctttgctgggcgccagacccggctttgccgtccggctattagcctactgtggctagtcacccccggggtcccggccttctcgggctggggccgccgccaccgcggcaggacggggaggcgggccatggcgtcctgcgtggggagccggaccctaagcaaggatgatgtgaactacaaaatgcatttccggatgatcaacgagcagcaagtggaggacatcaccattgacttcttctaccggccgcataccatcaccctgctcagcttcaccatcgtcagcctcatgtacttcgcctttaccagggatgactctgttccagaagacaacatctggagaggcatcctctctgttattttcttctttcttatcatcagtgtgttagctttccccaatggtccgttcactcgacctcatccagccttatggcgaatggtttttggactcagtgtgctctacttcctgttcctggtattcctactcttcctgaatttcgagcaggttaaatctctaatgtattggctagatccaaatcttcgatacgccacaagggaagcagatgtcatggagtatgctgtgaactgccatgtgatcacctgggagaggattatcagccactttgatatttttgcatttggacatttctggggctgggccatgaaggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttggggtcattggtttcctggaggccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaggtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagctaggtgccttttacatcgggtttgttctccttccatggtgtgttgctgacattgtcactgagtcccatgtgaggtgctggtgagtattacctttcatctgtgccatgctctagaaccttgaccttgatagttcaccacctctgatggatccctgttttaaataaaaacgattcactttaaagcctaaaaaaaaaatactctaaggggggccccgtacccatttttccttattgtagttgttttaactccgctttattgccg

SEQ ID NO: 372656 - DNA, 2302 bp, Homo sapiens
ttcagtctctctctctctctctcacacacacacacacacacccacacatgtgcacacacgtacacacacgcatgcacccacatgcaaacgcacacacatgatgatgactgtgctgtccagagcctctttccctggagctcctgggcagctgggacattttacttgttaaggtccgttcactcgacctcatccagccttatggcgaatggtttttggactcagtgtgctctacttcctgttcctggtattcctactcttcctgaatttcgagcaggttaaatctctaatgtattggctagatccaaatcttcgatacgccacaagggaagcagatgtcatggagtatgctgtgaactgccatgtgatcacctgggagaggattatcagccactttgatatttttgcatttggacatttctggggctgggccatgaaggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttggggtcattggtttcctggaggccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaggtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagctaggtgccttttacatcgggtttgttctccttccatggtgtgttgctgacattgtcactgagtcccatgtgaggtgctggtgagtattacctttcatctgtgccatgctctagaaccttgaccttgatagttcaccacctctgatggatccctgttttaaataaaaacgattcactttaaagccta

SEQ ID NO: 372657 - DNA, 1402 bp, Homo sapiens
tatttacaccttcagtctaaagaacttaaggcatgttgtggaagattgattctgcatcacctgtgagaggaaagaaccttgtttttatagcagagaaatataagcacagggaggttctgtcacttgccagtgatgatcccagcctgggagaggcagggatgcatcatgctcgcctttttgccctgccacttctcccagggagttcctaaaattcctgcactaagcctgtctctctccctagacctactcggagtgtgaagatggcacctacagtccagagatctcctggcatcacaggaaagggacaaaaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaggtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagctaggtgccttttacatcgggtttgttctccttccatggtgtgttgctgacattgtcactgagtcccatgtgaggtgctggtgagtattacctttcatctgtgccatgctctagaaccttgaccttgatagttcaccacctctgatggatccctgttttaaataaaaacgattcactttaaagccta

SEQ ID NO: 372658 - DNA, 1471 bp, Homo sapiens
ccttggttgcagggcaggatgggcaccgcgtggtgtgtgttttaattgcccctcgtttgggcttccgtttcacttgtgctctcacttctggtcctcaccatcatgaccatgtccatcatacacaggacagatgtacacacgcttcaggaaccacccagactttggggcgctattgcgttgaaccccgcgccaccgcgtgtgctccttcagtactagttctgtgtttgagagcctcgccttcatttatgaatgaggccactagggggagtgcacgtatcagggaaggacctgttccccggcaagcctagggcggtctggaaagggacagtcaccaatctccagagcccagggtgacggtgtgctctgattcctttggccaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaggtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagctaggtgccttttacatcgggtttgttctccttccatggtgtgttgctgacattgtcactgagtcccatgtgaggtgctggtgagtattacctttcatctgtgccatgctctagaaccttgaccttgatagttcaccacctctgatggatccctgttttaaataaaaacgattcactttaaagccta

SEQ ID NO: 372659 - DNA, 2120 bp, Homo sapiens
cagagccccctcctgaggcttctcacactgcgctaattagccagcatggttgagttttcactacatcagccagggaaaaacacaaaacaaaaccaatcaccctctactgggccgcgaaaacctaaaggcccttgaggccctggggcgcggtctggacgcgggtgcgccggaacctgaaccctcgccaggagcgcgatcctcgtgctggggcagctcctgctttacctgtggcgaggcctgcttcccgtagcgggtgaccccgggaccgaccaactcgctgggccgcacgtcccgtcccgccgcgccgcacgccggctcctcagcccgccctacacagcgcagccgcgctcccgggcccacgtgggccgcgcccggagtgggcgagaccatgtgccgggttacgcggggagacagcgggctacgtgctctgaaaagagccagccaggggccccggctacccttctccggctcgctattcctctgaagtcctgtggacttggagtctgaaaattcctcgagtggtagagatgcctcagctaggatgacagcgtggggacggccggcggcgtcccctgccccaggccgcggtggcggcgccgcgaccccgccctctcgcgcctgtccttccctctgctcccagcctttgctgggcgccagacccggctttgccgtccggctattagcctactgtggctagtcacccccggggtcccggccttctcgggctggggccgccgccaccgcggcaggacggggaggcgggccatggcgtcctgcgtggggagccggaccctaagcaaggatgatgtgaactacaaaatgcatttccggatgatcaacgagcagcaagtggaggacatcaccattgacttcttctaccggccgcataccatcaccctgctcagcttcaccatcgtcagcctcatgtacttcgcctttaccagggatgactctgttccagaagacaacatctggagaggcatcctctctgttattttcttctttcttatcatcagtgtgttagctttccccaatggtccgttcactcgacctcatccagccttatggcgaatggtttttggactcagtgtgctctacttcctgttcctggtattcctactcttcctgaatttcgagcaggttaaatctctaatgtattggctagatccaaatcttcgatacgccacaagggaagcagatgtcatggagtatgctgtgaactgccatgtgatcacctgggagaggattatcagccactttgatatttttgcatttggacatttctggggctgggccatgaaggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttgggtgagtaatctgttattgtggagatttaaaaaccacttaagccctaattttatttgggtatttcttgaccctgtgttaagagcctttcagtataatttttctatgaagacaggtggactagattttatatatctatatctatatctatatatacatagatatatcttttcatctttaatattcccttttctgatttaagttaaggaatagttacttggcaaattataaaacaagagtatagaaatggctctcttattttggccgggtgcagtggctcatgcc

SEQ ID NO: 372660 - DNA, 899 bp, Homo sapiens
tttttttgataggctttaaagtgaatcgtttttatttaaaacagggatccatcagaggtggtgaactatcaaggtcaaggttctagagcatggcacagatgaaaggtaatactcaccagcacctcacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaggtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagctaggtgccttttacatcgggtttgttctccttccatggtgtgttgctgacattgtcactgagtcccatgtgaggtgctggtgagtattacctttcatctgtgccatgctctagaaccttgaccttgatagttcaccacctctgatggatccctgttttaaataaaaacgattcactttaaagccta

SEQ ID NO: 372661 - DNA, 2380 bp, Homo sapiens
tggcgaattcggcacgaggcagcctttgctgggcgccagacccggctttgccgtccggctattagcctactgtggctagtcacccccggggtcccggccttctcgggctggggccgccgccaccgcggcaggacggggaggcgggccatggcgtcctgcgtggggagccggaccctaagcaaggatgatgtgaactacaaaatgcatttccggatgatcaacgagcagcaagtggaggacatcaccattgacttcttctaccggccgcataccatcaccctgctcagcttcaccatcgtcagcctcatgtacttcgcctttaccagggatgactctgttccagaagacaacatctggagaggcatcctctctgttattttcttctttcttatcatcagtgtgttagctttccccaatggagtatgctgtgaactgccatgtgatcacctgggagaggattatcagccactttgatatttttgcatttggacatttctggggctgggccatgaaggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttggggtcattggtttcctggaggccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaggtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagctaggtgccttttacatcgggtttgttctccttccatggtgtgttgctgacattgtcactgagtcccatgtgaggtgctggtgagtattacctttcatctgtgccatgctctagaaccttgaccttgatagttcaccacctctgatggatccctgttttaaataaaaacgattcactttaaagccta

SEQ ID NO: 372662 - DNA, 3168 bp, Homo sapiens
cagagccccctcctgaggcttctcacactgcgctaattagccagcatggttgagttttcactacatcagccagggaaaaacacaaaacaaaaccaatcaccctctactgggccgcgaaaacctaaaggcccttgaggccctggggcgcggtctggacgcgggtgcgccggaacctgaaccctcgccaggagcgcgatcctcgtgctggggcagctcctgctttacctgtggcgaggcctgcttcccgtagcgggtgaccccgggaccgaccaactcgctgggccgcacgtcccgtcccgccgcgccgcacgccggctcctcagcccgccctacacagcgcagccgcgctcccgggcccacgtgggccgcgcccggagtgggcgagaccatgtgccgggttacgcggggagacagcgggctacgtgctctgaaaagagccagccaggggccccggctacccttctccggctcgctattcctctgaagtcctgtggacttggagtctgaaaattcctcgagtggtagagatgcctcagctaggatgacagcgtggggacggccggcggcgtcccctgccccaggccgcggtggcggcgccgcgaccccgccctctcgcgcctgtccttccctctgctcccagcctttgctgggcgccagacccggctttgccgtccggctattagcctactgtggctagtcacccccggggtcccggccttctcgggctggggccgccgccaccgcggcaggacggggaggcgggccatggcgtcctgcgtggggagccggaccctaagcaaggatgatgtgaactacaaaatgcatttccggatgatcaacgagcagcaagtggaggacatcaccattgacttcttctaccggccgcataccatcaccctgctcagcttcaccatcgtcagcctcatgtacttcgcctttaccagggatgactctgttccagaagacaacatctggagaggcatcctctctgttattttcttctttcttatcatcagtgtgttagctttccccaatggtccgttcactcgacctcatccagccttatggcgaatggtttttggactcagtgtgctctacttcctgttcctggtattcctactcttcctgaatttcgagcaggttaaatctctaatgtattggctagatccaaatcttcgatacgccacaagggaagcagatgtcatggagtatgctgtgaactgccatgtgatcacctgggagaggattatcagccactttgatatttttgcatttggacatttctggggctgggccatgaaggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttggggtcattggtttcctggaggccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaggtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagctaggtgccttttacatcgggtttgttctccttccatggtgtgttgctgacattgtcactgagtcccatgtgaggtgctggtgagtattacctttcatctgtgccatgctctagaaccttgaccttgatagttcaccacctctgatggatccctgttttaaataaaaacgattcactttaaagccta

SEQ ID NO: 372663 - DNA, 2861 bp, Homo sapiens
  misc_feature (2787)..(2787): n is a, c, g, or t
  misc_feature (2799)..(2799): n is a, c, g, or t
cagagccccctcctgaggcttctcacactgcgctaattagccagcatggttgagttttcactacatcagccagggaaaaacacaaaacaaaaccaatcaccctctactgggccgcgaaaacctaaaggcccttgaggccctggggcgcggtctggacgcgggtgcgccggaacctgaaccctcgccaggagcgcgatcctcgtgctggggcagctcctgctttacctgtggcgaggcctgcttcccgtagcgggtgaccccgggaccgaccaactcgctgggccgcacgtcccgtcccgccgcgccgcacgccggctcctcagcccgccctacacagcgcagccgcgctcccgggcccacgtgggccgcgcccggagtgggcgagaccatgtgccgggttacgcggggagacagcgggctacgtgctctgaaaagagccagccaggggccccggctacccttctccggctcgctattcctctgaagtcctgtggacttggagtctgaaaattcctcgagtggtagagatgcctcagctaggatgacagcgtggggacggccggcggcgtcccctgccccaggccgcggtggcggcgccgcgaccccgccctctcgcgcctgtccttccctctgctcccagcctttgctgggcgccagacccggctttgccgtccggctattagcctactgtggctagtcacccccggggtcccggccttctcgggctggggccgccgccaccgcggcaggacggggaggcgggccatggcgtcctgcgtggggagccggaccctaagcaaggatgatgtgaactacaaaatgcatttccggatgatcaacgagcagcaagtggaggacatcaccattgacttcttctaccggccgcataccatcaccctgctcagcttcaccatcgtcagcctcatgtacttcgcctttaccagggatgactctgttccagaagacaacatctggagaggcatcctctctgttattttcttctttcttatcatcagtgtgttagctttccccaatggtccgttcactcgacctcatccagccttatggcgaatggtttttggactcagtgtgctctacttcctgttcctggtattcctactcttcctgaatttcgagcaggttaaatctctaatgtattggctagatccaaatcttcgatacgccacaagggaagcagatgtcatggagtatgctgtgaactgccatgtgatcacctgggagaggattatcagccactttgatatttttgcatttggacatttctggggctgggccatgaaggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttggggtcattggtttcctggaggccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagcccctataccttctgcataatgaattaactagaaataactttgcaaggagaccagagctaagaccccctaaacctcnacagttaaatcnacaaactgctcgccagaacactacgaccacagccatttaggtagggatcctctagatgaccc

SEQ ID NO: 372664 - DNA, 2422 bp, Homo sapiens
cagagccccctcctgaggcttctcacactgcgctaattagccagcatggttgagttttcactacatcagccagggaaaaacacaaaacaaaaccaatcaccctctactgggccgcgaaaacctaaaggcccttgaggccctggggcgcggtctggacgcgggtgcgccggaacctgaaccctcgccaggagcgcgatcctcgtgctggggcagctcctgctttacctgtggcgaggcctgcttcccgtagcgggtgaccccgggaccgaccaactcgctgggccgcacgtcccgtcccgccgcgccgcacgccggctcctcagcccgccctacacagcgcagccgcgctcccgggcccacgtgggccgcgcccggagtgggcgagaccatgtgccgggttacgcggggagacagcgggctacgtgctctgaaaagagccagccaggggccccggctacccttctccggctcgctattcctctgaagtcctgtggacttggagtctgaaaattcctcgagtggtagagatgcctcagctaggatgacagcgtggggacggccggcggcgtcccctgccccaggccgcggtggcggcgccgcgaccccgccctctcgcgcctgtccttccctctgctcccagcctttgctgggcgccagacccggctttgccgtccggctattagcctactgtggctagtcacccccggggtcccggccttctcgggctggggccgccgccaccgcggcaggacggggaggcgggccatggcgtcctgcgtggggagccggaccctaagcaaggatgatgtgaactacaaaatgcatttccggatgatcaacgagcagcaagtggaggacatcaccattgacttcttctaccggccgcataccatcaccctgctcagcttcaccatcgtcagcctcatgtacttcgcctttaccagggatgactctgttccagaagacaacatctggagaggcatcctctctgttattttcttctttcttatcatcagtgtgttagctttccccaatggtccgttcactcgacctcatccagccttatggcgaatggtttttggactcagtgtgctctacttcctgttcctggtattcctactcttcctgaatttcgagcaggttaaatctctaatgtattggctagatccaaatcttcgatacgccacaagggaagcagatgtcatggagtatgctgtgaactgccatgtgatcacctgggagaggattatcagccactttgatatttttgcatttggacatttctggggctgggccatgaaggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttggggtcattggtttcctggaggccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaaggacagccccaccccaagcatgcgtgtgcaaccaacgaaagccaattcttcccagcgacacaggcacatcgcgccattcccaacgtcgcaacgaaggtccaccaactgcgcgtcgggacaagaaatggacacacacccctggtctcaatccaaagcatgtacccagaagcatgccgtagaactgacagaggcgcacatggggaacctccattccggcaaccatcccccgccgaagagaccgtcggacgcgccccaccgggcactgccaggccaaaccaggccgaacgccccccctgcccgcgcccacacaccctcgccgcactccaccacagccacg

SEQ ID NO: 372665 - DNA, 1448 bp, Homo sapiens
cagagccccctcctgaggcttctcacactgcgctaattagccagcatggttgagttttcactacatcagccagggaaaaacacaaaacaaaaccaatcaccctctactgggccgcgaaaacctaaaggcccttgaggccctggggcgcggtctggacgcgggtgcgccggaacctgaaccctcgccaggagcgcgatcctcgtgctggggcagctcctgctttacctgtggcgaggcctgcttcccgtagcgggtgaccccgggaccgaccaactcgctgggccgcacgtcccgtcccgccgcgccgcacgccggctcctcagcccgccctacacagcgcagccgcgctcccgggcccacgtgggccgcgcccggagtgggcgagaccatgtgccgggttacgcggggagacagcgggctacgtgctctgaaaagagccagccaggggccccggctacccttctccggctcgctattcctctgaagtcctgtggacttggagtctgaaaattcctcgagtggtagagatgcctcagctaggatgacagcgtggggacggccggcggcgtcccctgccccaggccgcggtggcggcgccgcgaccccgccctctcgcgcctgtccttccctctgctcccagcctttgctgggcgccagacccggctttgccgtccggctattagcctactgtggctagtcacccccggggtcccggccttctcgggctggggccgccgccaccgcggcaggacggggaggcgggccatggcgtcctgcgtggggagccggaccctaagcaaggatgatgtgaactacaaaatgcatttccggatgatcaacgagcagcaagtggaggacatcaccattgacttcttctaccggccgcataccatcaccctgctcagcttcaccatcgtcagcctcatgtacttcgcctttaccagggatgactctgttccagaagacaacatctggagaggcatcctctctgttattttcttctttcttatcatcagtgtgttagctttccccaatggtccgttcactcgacctcatccagccttatggcgaatggtttttggactcagtgtgctctacttcctgttcctggtattcctactcttcctgaatttcgagcaggttaaatctctaatgtattggctagatccaaatcttcgatacgccacaagggaagcagatgtcatggtatgtacttgtcagtggcctcttggagaaactcgtagactctttcttgggtgtaagaggtaatagacttgacattttaaattgttccttctctgtatttcctgtgtagttacctaaaaaccaggtctctgggagggttgttgagttgcatggttgtccacaggtgatagagttcagggaaagaaaatcctctcattacgcaaaggggtctgtgaggaagaatgcacactttatcgtcagac

SEQ ID NO: 372666 - DNA, 439 bp, Homo sapiens
acctgtttcggtaatgcgaactcattagggctatgctcctactcagcttttgtgcaagcaactctagataaagtgctactcaaatatcccccaaatctgtcaccaacttaattcagacaccagaaaaaaacaaaaacttagagaaacagaggtagtccaaagacatgttagggagacaattgtggtaaggtggaatttctcatgtgaatttaaaagtttatttaaaagtgaatgtaaaaatctacttcctcctcttcccaggcagctaataacctagctttattgttaatcagaaaaaaataataaatataaaaatgtaggtttggcacggtggttcacgcctgtaatcccagcactttgggaggccaaggtgggaagatcacctgaggcctggaattcgacaccagcctgggcaacatagcgaaactttgcctctacc

SEQ ID NO: 372667 - DNA, 455 bp, Homo sapiens
gaaacatcctcatctcaattaatccataagtcacatcacaggtttttgtgttggttttgttttgtttttctgtcaccacgattctccatccaatggctcttgtggaataaagcaatgcacagaagtggcactaagaagtctgttttttttgtttttgtttttgtttttagagatagcatcttggcccgggcgtggtggctcacgcctataatcccagcactttgggaggctgaggtgggtggatcacaaggtcagggtttcgagatcagcttggccaatatagtgaaaccctgtctctactaaaaatccaaaaaaaaaaaaaaaaaatcagccaggtgtggtggcacacacctgtagtcccagctacttgggaggccaagggacggaggttgcagtgagccaagatcacgccactgcactccagcctgggcaacaagagtgagattccatctcaa

SEQ ID NO: 372668 - DNA, 620 bp, Homo sapiens
tagaaataaaatatataccagttaagaataatttattatttaggccaggcatggtataatctcagcactttgagaccctgtctcgttatacctgtaatcccagcgctttgagagactgaggcaggaggatcacttgaggccaggagttcaagacgagctggggcaacatagcaagaccccatctctacaaaaaataattttttcaaaaaagagtaattggttatacacttctgaagagccaataaacaatctctacttagacaacttaaagttatttcaattattactttataacattttttaaacttttattgaagttcagtggtacaagtgcaggtttgttacataggtaaacttggtcatgggggtttgttgtgcaggttatttcatcacttaggtattaagcctagtacctattagttatttttcctgatcctcttcctcctcccaccctccaccctccaaaaggccccagtatgtgatgttcccctctgtgtccatgtgttctcatcatttagctcccacttataagtgagaacaggcagtattcagttttctgttcctatgttagtttgctaactttataacatttaacataaaaataggaagttttattttta

SEQ ID NO: 372669 - DNA, 402 bp, Homo sapiens
aacagtcatttaacactgtgccaccccttcccctaagctggcatagtaccactcacagagattttccctagacccatggttgctagtgaaggagggaattggaggtgaatattcgatctccccactggtctaggaatcttcatgcgaagtccattctggtcctatttgatcagaaccattgggagtgtcaggaaagcttaactacttggggtgaggtggaaacaatgacctgggtgttcatcacagaaagctgatctcggcactctgatcagtggggatgccaagttaaacaaactggccaggaccatagtgcctcaggggcacaatccagaggaaggcccaaatccccagctgggttttccacaaatcccaggtgcgtgagtggagccttcctctagctca

SEQ ID NO: 372670 - DNA, 534 bp, Homo sapiens
tgaaaggggagaaaaggcttgtcgctaggccaccattactcccgctagcacgcagttcataggccaacactcaccttaagaagtactccctttagagggtgctcccagttagagcacatttcttatgccattctattccattcattcaagaagacactcactgagtgtctattctaatactttagaatgatttcagcagtatcttggaagtttgggaacccgcatcaggaatagctcaggagaggatgttttgtcttcctgcctgacaggcatcaccagcaatcagagtagggtgccctgtgcgtgacctgacccttgtctgtgtggccacctgtgtggtgcttgccctctggcagcctggagcccactgggcagcagtgttggcaacgttgcagaaggcatctgaactctagggctgtcctcactgttgacttattattttattagatttatgcagcagcctgcctccaaagaagaaatttggtgtgttttttcattgggaagtaattccagactgcaggaaaaaagcattta

SEQ ID NO: 372671 - DNA, 315 bp, Homo sapiens
gtgcacgtgcacacacacacagaggcatatacacacatgcttaacatattgcaaagaaagtctgcctgtaatcccagcaggtcaaggcagaaggatcgcttgagcccaggagttcaaaaccagcttgggcaatatagtgaaatcttgtctctacaaaaactaaagagttagcttggcatggtagtgtacatctgtagtcccagctacttgggagactgaggcagaggatcacttgagccaggaggttgaggctgcattgagctgtgatcatgccactgcactccagcctggaagacggagcaagaccttgtctca

SEQ ID NO: 372672 - DNA, 373 bp, Homo sapiens
atagccgcacgcagaagaatgaaattggatccttgttgtacaccatatacaatcagtaactcaaaatgaataacaactgaaaatataaggtctgagactgtagaactcccacaagaaaacataggggacaaaacagctctttgactttggtcttggcaataattttttgaatactacaccaaaggcacaggcaacaaaagcaaaaatacgtgtgactatatcacactaaaaagcttcttgcacgaaaaaaagaaaaaaatcaacaaaacgaaaaaacaacctacaaaatagtagaaaatatttgcaaaccatatttgtgataaggggttaagtatccaaaatctataaggaactcaccagcttaatggcaaaa

SEQ ID NO: 372673 - DNA, 335 bp, Homo sapiens
gcaagcaccagctccacatagtgacacagtaccggaagggcaaggattctctgtgtgcccagggaaagtggttttatgataggaaggacagtggcttatagtagtgtgtctggagttggttccttcggtgggttcatggtctcgctgacttcaagaccgtggaccttggcagtgagtggtacagctcttaaagatggcacggacccaaagagtgagcagtagcaaggtttattgtgaagagcaaaagaacaaagctttcacagcgtggaaggggacccaagcaggttgctgctgctggctggggtggccagcttttattcccttatttgtcccct

SEQ ID NO: 372674 - DNA, 417 bp, Homo sapiens
gtatatcttcttgggagaaatatctattcaaatcatttgcccattttaaaattgggttctctttttttttaatggttgagttgtaagagttttttatatattctggaaattagctccttatcaaatgtattatttgcagttattttctcccatctggtggatcatcttttcattttctcgatgttatcatttgaagcacaaaacgtttccattttcatgaagtagaatgtatcttttgtcatatatgattttgttattgtatctaagtaaaattgcctaactcaaggtcatgaatatttatggcatatgttttcttctaaggagctgtatagttttaggctctttccatttatatttatggatcccgtgttgaggttcactttgatgtaggggtgtggacataatgttctaaattca

SEQ ID NO: 372675 - DNA, 222 bp, Homo sapiens
gcctaccttggcctcccaaagtgctgggattagaggcatgaaccactgcgtgcagcagatcctacttattaatagaagtgtcagatgtgtgatcatccttaatccaccatacttggcacctagtttggtactagcagaagtgtagggctcttggtgtggctcaaagcttcacaaaatttaaactcgttactgagttgttcaatatgttggtcttgttgaatt

SEQ ID NO: 372676 - DNA, 385 bp, Homo sapiens
aaatcatccctagattacttataatacctgatacaatataaatgctaaatagctgtaacactgtatctttaaaatttacattattttttgttgttgtattattatttttattgtatttttaaaaaatattttccatctacagtcagtagaatccacggatacagaacctatggataggaaggaccaactgtatcttttagtgttttgaggttcttgaattctcaggtcgtttgctttcctttgctttctcccaagtcttgttttacaatttgctttagtcattcactgaaactttaaaaaacattagaaaacctcacagtttgtaaatctttttccctattatatatatcataagataggagcttaaataaagagttttagaaac

SEQ ID NO: 372677 - DNA, 2835 bp, Homo sapiens
gaacattgaggatggcgcgtgcccgcggctccccgtgccccccgctgccgcccggtaggatgtcctggccccacggggcattgctcttcctctggctcttctccccacccctgggggccggtggaggtggagtggccgtgacgtctgccgccggagggggctccccgccggccacctcctgccccgtggcctgctcctgcagcaaccaggccagccgggtgatctgcacacggagagacctggccgaggtcccagccagcatcccggtcaacacgcggtacctgaacctgcaagagaacggcatccaggtgatccggacggacacgttcaagcacctgcggcacctggagattctgcagctgagcaagaacctggtgcgcaagatcgaggtgggcgccttcaacgggctgcccagcctcaacacgctggagctttttgacaaccggctgaccacggtgcccacgcaggccttcgagtacctgtccaagctgcgggagctctggctgcggaacaaccccatcgagagcatcccctcctacgccttcaaccgcgtgccctcgctgcggcgcctggacctgggcgagctcaagcggctggaatacatctcggaggcggccttcgaggggctggtcaacctgcgctacctcaacctgggcatgtgcaacctcaaggacatccccaacctgacggccctggtgcgcctggaggagctggagctgtcgggcaaccggctggacctgatccgcccgggctccttccagggtctcaccagcctgcgcaagctgtggctcatgcacgcccaggtagccaccatcgagcgcaacgccttcgacgacctcaagtcgctggaggagctcaacctgtcccacaacaacctgatgtcgctgccccacgacctcttcacgcccctgcaccgcctcgagcgcgtgcacctcaaccacaacccctggcattgcaactgcgacgtgctctggctgagctggtggctcaaggagacggtgcccagcaacacgacgtgctgcgcccgctgtcatgcgcccgccggcctcaaggggcgctacattggggagctggaccagtcgcatttcacctgctatgcgcccgtcatcgtggagccgcccacggacctcaacgtcaccgagggcatggctgccgagctcaaatgccgcacgggcacctccatgacctccgtcaactggctgacgcccaacggcaccctcatgacccacggctcctaccgcgtgcgcatctccgtcctgcatgacggcacgcttaacttcaccaacgtcaccgtgcaggacacgggccagtacacgtgcatggtgacgaactcagccggcaacaccaccgcctcggccacgctcaacgtctcggccgtggaccccgtggcggccgggggcaccggcagcggcgggggcggccctgggggcagtggtggtgttggagggggcagtggcggctacacctacttcaccacggtgaccgtggagaccctggagacgcagcccggagaggaggccctgcagccgcgggggacggagaaggaaccgccagggcccacgacagacggtgtctggggtgggggccggcctggggacgcggccggccctgcctcgtcttctaccacggcacccgccccgcgctcctcgcggcccacggagaaggcgttcacggtgcccatcacggatgtgacggagaacgccctcaaggacctggacgacgtcatgaagaccaccaaaatcatcatcggctgcttcgtggccatcacgttcatggccgcggtgatgctcgtggccttctacaagctgcgcaagcagcaccagctccacaagcaccacgggcccacgcgcaccgtggagatcatcaacgtggaggacgagctgcccgccgcctcggccgtgtccgtggccgccgcggccgccgcggccagtgggggtggtgtgggcggggacagccacctggccctgcccgccctggagcgagaccacctcaaccaccaccactacgtggctgccgccttcaaggcgcactacagcagcaaccccagcggcgggggctgcgggggcaaaggcccgcctggcctcaactccatccacgaacctctgctcttcaagagcggctccaaggagaacgtgcaagagacgcagatctgaggcggcggggccgggcgggcgaggggcgtggagccccccacccaggtcccagcccgggcgcagcctgaccgggacccctccctcccacagcccagcccaccttctgggaccacgcagggaattggggagaggtggcttccagccccatctggggctcggacccccagtaaggacagggtggggctccaggagcggagtctctgggatcctcgcctcacccccgccaatccccggtgacgggaggggacgtgggacccaggagaagtggcctgagttctccgcgtttcctcctcgctctcccaccaagcgttccgggcccgccgccttccaggggagagaggagctttctccaggggtgtcctttcccctcggccccaaacaccttccttttacggttcagtttttgcagtttgacgcccgtccctccctcccactcctccgccctcaaaactgaagagatggacacgtcgccagagctcccgtcccagcgcccggctctgctcccggccggcggtccctgtcgtcggcgcgggggggagcctccacccgccccagccccacctgccccacagacacttttgatactgaagggaggtttgcgtcaacgactacctgctctgtaattactttaaaaaaaaaacatggaaaaagtaaaaaaatattttttttggtcatgaaagca

SEQ ID NO: 372678 - DNA, 1051 bp, Homo sapiens
  misc_feature (14)..(14): n is a, c, g, or t
  misc_feature (17)..(17): n is a, c, g, or t
  misc_feature (35)..(35): n is a, c, g, or t
  misc_feature (40)..(40): n is a, c, g, or t
  misc_feature (42)..(42): n is a, c, g, or t
agttccatttattnggntacaccattattgaaacncccgntntgggtttaaaagcagctgtcggccgattcgggatgacatgagatgcgcgtccgcgtcccgtgccccgctgcgccgtagatgtcctggccccacggggcattgctcttcctctggctcttctccccacccctgggggccggtggaggtggagtggccgtgacgtctgccgccggagggggctccccgccggccacctcctgccccgtggcctgctcctgcagcaaccaggccagccgggtgatctgcacacggagagacctggccgaggtcccagccagcatcccggtcaacacgcggtacctgaacctgcaagagaacggcatccaggtgatccggacggacacgttcaagcacctgcggcacctggagattctgcagctgagcaagaacctggtgcgcaagatcgaggtgggcgccttcaacgggctgcccagcctcaacacgctggagctttttgacaaccggctgaccacggtgcccacgcaggccttcgagtacctgtccaagctgcgggagctctggctgcggaacaaccccatcgagagcatcccctcctacgccttcaaccgcgtgccctcgctgcggcgcctggacctgggcgagctcaagcggctggaatacatctcggaggcggccttcgaggggctggtcaacctgcgctacctcaacctgggcatgtgcaacctcaaggacatccccaacctgacggccctggtgcgcctggaggagctggagctgtcgggcaaccggctggacctgatccgcccgggctccttccagggtctcaccagcctgcgcaagctgtggctcatgcacgcccaggtagccaccatcgagcgcaacgccttcgacgacctcaagtcgctggaggagctcaacctgtcccacctgccccacagacacttttgatactgaagggaggtttgcgtcaacgactacctgctctgtaattactttaaaaaaaaaacatggaaaaagtaaaaaaatattttttttggtcatgaaagca

SEQ ID NO: 372679 - DNA, 2896 bp, Homo sapiens
  misc_feature (14)..(14): n is a, c, g, or t
  misc_feature (17)..(17): n is a, c, g, or t
  misc_feature (35)..(35): n is a, c, g, or t
  misc_feature (40)..(40): n is a, c, g, or t
  misc_feature (42)..(42): n is a, c, g, or t
agttccatttattnggntacaccattattgaaacncccgntntgggtttaaaagcagctgtcggccgattcgggatgacatgagatgcgcgtccgcgtcccgtgccccgctgcgccgtagatgtcctggccccacggggcattgctcttcctctggctcttctccccacccctgggggccggtggaggtggagtggccgtgacgtctgccgccggagggggctccccgccggccacctcctgccccgtggcctgctcctgcagcaaccaggccagccgggtgatctgcacacggagagacctggccgaggtcccagccagcatcccggtcaacacgcggtacctgaacctgcaagagaacggcatccaggtgatccggacggacacgttcaagcacctgcggcacctggagattctgcagctgagcaagaacctggtgcgcaagatcgaggtgggcgccttcaacgggctgcccagcctcaacacgctggagctttttgacaaccggctgaccacggtgcccacgcaggccttcgagtacctgtccaagctgcgggagctctggctgcggaacaaccccatcgagagcatcccctcctacgccttcaaccgcgtgccctcgctgcggcgcctggacctgggcgagctcaagcggctggaatacatctcggaggcggccttcgaggggctggtcaacctgcgctacctcaacctgggcatgtgcaacctcaaggacatccccaacctgacggccctggtgcgcctggaggagctggagctgtcgggcaaccggctggacctgatccgcccgggctccttccagggtctcaccagcctgcgcaagctgtggctcatgcacgcccaggtagccaccatcgagcgcaacgccttcgacgacctcaagtcgctggaggagctcaacctgtcccacaacaacctgatgtcgctgccccacgacctcttcacgcccctgcaccgcctcgagcgcgtgcacctcaaccacaacccctggcattgcaactgcgacgtgctctggctgagctggtggctcaaggagacggtgcccagcaacacgacgtgctgcgcccgctgtcatgcgcccgccggcctcaaggggcgctacattggggagctggaccagtcgcatttcacctgctatgcgcccgtcatcgtggagccgcccacggacctcaacgtcaccgagggcatggctgccgagctcaaatgccgcacgggcacctccatgacctccgtcaactggctgacgcccaacggcaccctcatgacccacggctcctaccgcgtgcgcatctccgtcctgcatgacggcacgcttaacttcaccaacgtcaccgtgcaggacacgggccagtacacgtgcatggtgacgaactcagccggcaacaccaccgcctcggccacgctcaacgtctcggccgtggaccccgtggcggccgggggcaccggcagcggcgggggcggccctgggggcagtggtggtgttggagggggcagtggcggctacacctacttcaccacggtgaccgtggagaccctggagacgcagcccggagaggaggccctgcagccgcgggggacggagaaggaaccgccagggcccacgacagacggtgtctggggtgggggccggcctggggacgcggccggccctgcctcgtcttctaccacggcacccgccccgcgctcctcgcggcccacggagaaggcgttcacggtgcccatcacggatgtgacggagaacgccctcaaggacctggacgacgtcatgaagaccaccaaaatcatcatcggctgcttcgtggccatcacgttcatggccgcggtgatgctcgtggccttctacaagctgcgcaagcagcaccagctccacaagcaccacgggcccacgcgcaccgtggagatcatcaacgtggaggacgagctgcccgccgcctcggccgtgtccgtggccgccgcggccgccgcggccagtgggggtggtgtgggcggggacagccacctggccctgcccgccctggagcgagaccacctcaaccaccaccactacgtggctgccgccttcaaggcgcactacagcagcaaccccagcggcgggggctgcgggggcaaaggcccgcctggcctcaactccatccacgaacctctgctcttcaagagcggctccaaggagaacgtgcaagagacgcagatctgaggcggcggggccgggcgggcgaggggcgtggagccccccacccaggtcccagcccgggcgcagcctgaccgggacccctccctcccacagcccagcccaccttctgggaccacgcagggaattggggagaggtggcttccagccccatctggggctcggacccccagtaaggacagggtggggctccaggagcggagtctctgggatcctcgcctcacccccgccaatccccggtgacgggaggggacgtgggacccaggagaagtggcctgagttctccgcgtttcctcctcgctctcccaccaagcgttccgggcccgccgccttccaggggagagaggagctttctccaggggtgtcctttcccctcggccccaaacaccttccttttacggttcagtttttgcagtttgacgcccgtccctccctcccactcctccgccctcaaaactgaagagatggacacgtcgccagagctcccgtcccagcgcccggctctgctcccggccggcggtccctgtcgtcggcgcgggggggagcctccacccgccccagccccacctgccccacagacacttttgatactgaagggaggtttgcgtcaacgactacctgctctgtaattactttaaaaaaaaaacatggaaaaagtaaaaaaatattttttttggtcatgaaagca

SEQ ID NO: 372680 - DNA, 2508 bp, Homo sapiens
aaattcagctcgtttccgagcacattctgcagctgagcaagaacctggtgcgcaagatcgaggtgggcgccttcaacgggctgcccagcctcaacacgctggagctttttgacaaccggctgaccacggtgcccacgcaggccttcgagtacctgtccaagctgcgggagctctggctgcggaacaaccccatcgagagcatcccctcctacgccttcaaccgcgtgccctcgctgcggcgcctggacctgggcgagctcaagcggctggaatacatctcggaggcggccttcgaggggctggtcaacctgcgctacctcaacctgggcatgtgcaacctcaaggacatccccaacctgacggccctggtgcgcctggaggagctggagctgtcgggcaaccggctggacctgatccgcccgggctccttccagggtctcaccagcctgcgcaagctgtggctcatgcacgcccaggtagccaccatcgagcgcaacgccttcgacgacctcaagtcgctggaggagctcaacctgtcccacaacaacctgatgtcgctgccccacgacctcttcacgcccctgcaccgcctcgagcgcgtgcacctcaaccacaacccctggcattgcaactgcgacgtgctctggctgagctggtggctcaaggagacggtgcccagcaacacgacgtgctgcgcccgctgtcatgcgcccgccggcctcaaggggcgctacattggggagctggaccagtcgcatttcacctgctatgcgcccgtcatcgtggagccgcccacggacctcaacgtcaccgagggcatggctgccgagctcaaatgccgcacgggcacctccatgacctccgtcaactggctgacgcccaacggcaccctcatgacccacggctcctaccgcgtgcgcatctccgtcctgcatgacggcacgcttaacttcaccaacgtcaccgtgcaggacacgggccagtacacgtgcatggtgacgaactcagccggcaacaccaccgcctcggccacgctcaacgtctcggccgtggaccccgtggcggccgggggcaccggcagcggcgggggcggccctgggggcagtggtggtgttggagggggcagtggcggctacacctacttcaccacggtgaccgtggagaccctggagacgcagcccggagaggaggccctgcagccgcgggggacggagaaggaaccgccagggcccacgacagacggtgtctggggtgggggccggcctggggacgcggccggccctgcctcgtcttctaccacggcacccgccccgcgctcctcgcggcccacggagaaggcgttcacggtgcccatcacggatgtgacggagaacgccctcaaggacctggacgacgtcatgaagaccaccaaaatcatcatcggctgcttcgtggccatcacgttcatggccgcggtgatgctcgtggccttctacaagctgcgcaagcagcaccagctccacaagcaccacgggcccacgcgcaccgtggagatcatcaacgtggaggacgagctgcccgccgcctcggccgtgtccgtggccgccgcggccgccgcggccagtgggggtggtgtgggcggggacagccacctggccctgcccgccctggagcgagaccacctcaaccaccaccactacgtggctgccgccttcaaggcgcactacagcagcaaccccagcggcgggggctgcgggggcaaaggcccgcctggcctcaactccatccacgaacctctgctcttcaagagcggctccaaggagaacgtgcaagagacgcagatctgaggcggcggggccgggcgggcgaggggcgtggagccccccacccaggtcccagcccgggcgcagcctgaccgggacccctccctcccacagcccagcccaccttctgggaccacgcagggaattggggagaggtggcttccagccccatctggggctcggacccccagtaaggacagggtggggctccaggagcggagtctctgggatcctcgcctcacccccgccaatccccggtgacgggaggggacgtgggacccaggagaagtggcctgagttctccgcgtttcctcctcgctctcccaccaagcgttccgggcccgccgccttccaggggagagaggagctttctccaggggtgtcctttcccctcggccccaaacaccttccttttacggttcagtttttgcagtttgacgcccgtccctccctcccactcctccgccctcaaaactgaagagatggacacgtcgccagagctcccgtcccagcgcccggctctgctcccggccggcggtccctgtcgtcggcgcgggggggagcctccacccgccccagccccacctgccccacagacacttttgatactgaagggaggtttgcgtcaacgactacctgctctgtaattactttaaaaaaaaaacatggaaaaagtaaaaaaatattttttttggtcatgaaagca

SEQ ID NO: 372681 - DNA, 3159 bp, Homo sapiens
catatttggctagtggaaaaacaaagaccattcgacacatggtcgccaatgtgcgaggaaaccacatcgcttctgggagcacagacacatggaatgggaaaacgctaaaaatcccacctgttactccatccatcctggattgctgcattatcagagtggactattccttagctgtatacattcacattcctggtgctaaaaaattgatgctcgaactgccattagtgatcggtacaattccatataatggttttggcagcagaaactccagcattgccagccagttcagtatggatatgagctggttgacactgaccctgccagagcagcctgaagcaccaccaaattatgcagatgtggtatcagaggaagaattctctagacacattcctccttaccctcaaccccctaactgtgagggagaagtgtgctgtcctgtgtttgcctgtatacaagaattccggtttcaacccccacctctttattcagaggttgacccacatcctagcgacgtagaagagagccagcctgtttccttcattctctgaacgtatttcagaaatcactgtgttcatcatcaaattagaatgttggttcttttccttctgcctttttgggaaagagacaggaaagattcacttgaaaacataaatgaacgtcaagactgaaggcaatagaaattaaagaatgtgagaaagttctggtgggccggcaggattgccgcacaagtttatatgatggtcgtatatatatccctgttaaaaactgggatgaagatgtgcaaagtcacagaatgtaatggaagtcctgatggttacagagtaagtgaaagggtgcctgcgctgacgtgagagaaaggaatctgtaaacagtggaaacactgtgggagtttcccatggtgttttgaagagtggaacgaaggcgatatgaactgaaggggtgaagacttgattttggagagggcaacaaaacaagggtgtgtgtgcataggagaatggcccactccaaatacgaagtgagatcctgagtctttgggtgcttcatgatttcctaccatattcaggcctaaagacattgaaaaagcatcttttcttgagatcatggtcatatgaggtcctaatgaagtactacagttttcattctttcaagggtagactaaaatatagtttataaatcggcagtacagtattatgaaaccaagaaagggtttcttgaaaagcttgtcggttcaaagaggaaagatgaatttcaatgtggatatacgtttgattttcctcatatcttatttacctaggagcatgtcagagaaagaagggagagaaaaggttgcatctgcaggatgccttgataactacacagtcccaaataaaaggcctttttctaacctacctctaatggggttatcagatatgtttttaaatctctcgccctgagtactcttcttgggagttgctgctgtttacagccacagtctcatctatcactaaatatgaaactgggccaaggggaaaattcagtaagttagcgttaaatggaagtaaatatatgtatacctaagagaatgtcaaaataaacaccaaaccaaaagaaggtaggagtgccatttttagaaaagacacaactttaattcctgtcaagagacctaggtctactgatggcagtcactgcattgtacattattccagttcttcagtaattctgtttaaactgtgattttctttattgtgttggtgcaatattttattatcatttaacctcaggatattcagaccaacaggattgtgttgctgctgaaagtctgagcagtgttttaccgtccccagcccccctcccacatggtcacatgttcacttgcttttccttccatctgttggttttgtgagctgagagcatctctggacacatggaagggagccagggattcctgtgatacagattttgaaccagcagagtactttggttttcttcatgtcctaagggtttgatccagaaaccctggtgcttcccctgcagaatactgtacttcatttaacagaatgattgatttttctttcaatcagcatgttcaccaaaaatagaaaagttcttctaaggttaaattttgtatttaaaagttagttggccatttgatcagggaattttctacacacattaggcaaatgtatgcttttcatcctctgggcttacctctctcctctgcaatcctggaagcattgtgcatagttctttcattgtaagccgctatttaaattcccacaatgcaaaactgttagaccagtaattgtgctactgaaattgtcacaaaacgttattccttgatttggtttttaaattttgcttttgtgtgtgtgtctttaaacaggtaatgtgtatttaagtgttgtctaaacagttgatttttactttagaaaagatcatcttcaactgtttattgacttctgagttatatagttcatgccctgccaaggcattgttcgactccatgatactaaaacataatgaaagaaacaaactccagtatggagaagagaaagtttaattatttggttccatctagaaaagcaacaacttaaaggaatccttcactaggattgtcttatcacctttattagataaatcatgaagtgtccctgtgaaattgaagtgaaactatctctgtaggacttaagagaatagctaaaaggtgtgacttgccttattgaactgatactggcatatctgactgtaagcagtaggttgaagatatcattttatgaatgtggagaattctacattgaaacagaaaatacctgggaatgaagattaaaaatgtagctgctgttatttgcttggtgattcccctcttgctcttctttagtttgaaaaaacaaaaacgtggccttggaattttcattttgatgcagaaattttgaaattgaaaatgtgcatgttttggtgcacaaaatccttctgtgggcaaaactttgtttttgttttgcacagtaagaaacaataggcaagcgttatgtttttggtaagttaactatgaaagctttcttatttttattattaaaaatgtaacaatttaacccacaggaaaaaaaattactttgtatgcttgtttgaaccctatgggttcgttttattaataaaattattacactaatgctaaaaaaaaaa

SEQ ID NO: 372682 - DNA, 1560 bp, Homo sapiens
catatttggctagtggaaaaacaaagaccattcgacacatggtcgccaatgtgcgaggaaaccacatcgcttctgggagcacagacacatggaatgggaaaacgctaaaaatcccacctgttactccatccatcctggattgctgcattatcagagtggactattccttagctgtatacattcacattcctggtgctaaaaaattgatgctcgaactgccattagtgatcggtacaattccatataatggttttggcagcagaaactccagcattgccagccagttcagtatggatatgagctggttgacactgaccctgccagagcagcctgaagcaccaccaaattatgcagatgtggtatcagaggaagaattctctagacacattcctccttaccctcaaccccctaactgtgagggagaagtgtgctgtcctgtgtttgcctgtatacaagaattccggtttcaacccccacctctttattcagaggttgacccacatcctagcgacgtagaagagagccagcctgtttccttcattctctgaacgtatttcagaaatcactgtgttcatcatcaaattagaatgttggttcttttccttctgcctttttgggaaagagacaggaaagattcacttgaaaacataaatgaacgtcaagactgaaggcaatagaaattaaagaatgtgagaaagttctggtgggccggcaggattgccgcacaagtttatatgatggtcgtatatatatccctgttaaaaactgggatgaagatgtgcaaagtcacagaatgtaatggaagtcctgatggttacagagtaagtgaaagggtgcctgcgctgacgtgagagaaaggaatctgtaaacagtggaaacactgtgggagtttcccatggtgttttgaagagtggaacgaaggcgatatgaactgaaggggtgaagacttgattttggagagggcaacaaaacaagggtgtgtgtgcataggagaatggcccactccaaatacgaagtgagatcctgagtctttgggtgcttcatgatttcctaccatattcaggcctaaagacattgaaaaagcatcttttcttgagatcatggtcatatgaggtcctaatgaagtactacagttttcattctttcaagggtagactaaaatatagtttataaatcggcagtacagtattatgaaaccaagaaagggtttcttgaaaagcttgtcggttcaaagaggaaagatgaatttcaatgtgaaaacacgttttgttgagggctgtactttttaccccctttaagtgctttaacaggatatacgtttgattttcctcatatcttatttacctaggagcatgtcagagaaagaagggagagaaaaggttgcatctgcaggatgccttgataactacacagtcccaaataaaaggcctttttctaacctacctctaatggggttatcagatatgtttttaaatctctcgccctgagtactcttcttgggagttgctgctgtttacagccacagtctcatctatcgcattcgagtcctctgagtcagcc

SEQ ID NO: 372683 - DNA, 3213 bp, Homo sapiens
catatttggctagtggaaaaacaaagaccattcgacacatggtcgccaatgtgcgaggaaaccacatcgcttctgggagcacagacacatggaatgggaaaacgctaaaaatcccacctgttactccatccatcctggattgctgcattatcagagtggactattccttagctgtatacattcacattcctggtgctaaaaaattgatgctcgaactgccattagtgatcggtacaattccatataatggttttggcagcagaaactccagcattgccagccagttcagtatggatatgagctggttgacactgaccctgccagagcagcctgaagcaccaccaaattatgcagatgtggtatcagaggaagaattctctagacacattcctccttaccctcaaccccctaactgtgagggagaagtgtgctgtcctgtgtttgcctgtatacaagaattccggtttcaacccccacctctttattcagaggttgacccacatcctagcgacgtagaagagagccagcctgtttccttcattctctgaacgtatttcagaaatcactgtgttcatcatcaaattagaatgttggttcttttccttctgcctttttgggaaagagacaggaaagattcacttgaaaacataaatgaacgtcaagactgaaggcaatagaaattaaagaatgtgagaaagttctggtgggccggcaggattgccgcacaagtttatatgatggtcgtatatatatccctgttaaaaactgggatgaagatgtgcaaagtcacagaatgtaatggaagtcctgatggttacagagtaagtgaaagggtgcctgcgctgacgtgagagaaaggaatctgtaaacagtggaaacactgtgggagtttcccatggtgttttgaagagtggaacgaaggcgatatgaactgaaggggtgaagacttgattttggagagggcaacaaaacaagggtgtgtgtgcataggagaatggcccactccaaatacgaagtgagatcctgagtctttgggtgcttcatgatttcctaccatattcaggcctaaagacattgaaaaagcatcttttcttgagatcatggtcatatgaggtcctaatgaagtactacagttttcattctttcaagggtagactaaaatatagtttataaatcggcagtacagtattatgaaaccaagaaagggtttcttgaaaagcttgtcggttcaaagaggaaagatgaatttcaatgtgaaaacacgttttgttgagggctgtactttttaccccctttaagtgctttaacaggatatacgtttgattttcctcatatcttatttacctaggagcatgtcagagaaagaagggagagaaaaggttgcatctgcaggatgccttgataactacacagtcccaaataaaaggcctttttctaacctacctctaatggggttatcagatatgtttttaaatctctcgccctgagtactcttcttgggagttgctgctgtttacagccacagtctcatctatcactaaatatgaaactgggccaaggggaaaattcagtaagttagcgttaaatggaagtaaatatatgtatacctaagagaatgtcaaaataaacaccaaaccaaaagaaggtaggagtgccatttttagaaaagacacaactttaattcctgtcaagagacctaggtctactgatggcagtcactgcattgtacattattccagttcttcagtaattctgtttaaactgtgattttctttattgtgttggtgcaatattttattatcatttaacctcaggatattcagaccaacaggattgtgttgctgctgaaagtctgagcagtgttttaccgtccccagcccccctcccacatggtcacatgttcacttgcttttccttccatctgttggttttgtgagctgagagcatctctggacacatggaagggagccagggattcctgtgatacagattttgaaccagcagagtactttggttttcttcatgtcctaagggtttgatccagaaaccctggtgcttcccctgcagaatactgtacttcatttaacagaatgattgatttttctttcaatcagcatgttcaccaaaaatagaaaagttcttctaaggttaaattttgtatttaaaagttagttggccatttgatcagggaattttctacacacattaggcaaatgtatgcttttcatcctctgggcttacctctctcctctgcaatcctggaagcattgtgcatagttctttcattgtaagccgctatttaaattcccacaatgcaaaactgttagaccagtaattgtgctactgaaattgtcacaaaacgttattccttgatttggtttttaaattttgcttttgtgtgtgtgtctttaaacaggtaatgtgtatttaagtgttgtctaaacagttgatttttactttagaaaagatcatcttcaactgtttattgacttctgagttatatagttcatgccctgccaaggcattgttcgactccatgatactaaaacataatgaaagaaacaaactccagtatggagaagagaaagtttaattatttggttccatctagaaaagcaacaacttaaaggaatccttcactaggattgtcttatcacctttattagataaatcatgaagtgtccctgtgaaattgaagtgaaactatctctgtaggacttaagagaatagctaaaaggtgtgacttgccttattgaactgatactggcatatctgactgtaagcagtaggttgaagatatcattttatgaatgtggagaattctacattgaaacagaaaatacctgggaatgaagattaaaaatgtagctgctgttatttgcttggtgattcccctcttgctcttctttagtttgaaaaaacaaaaacgtggccttggaattttcattttgatgcagaaattttgaaattgaaaatgtgcatgttttggtgcacaaaatccttctgtgggcaaaactttgtttttgttttgcacagtaagaaacaataggcaagcgttatgtttttggtaagttaactatgaaagctttcttatttttattattaaaaatgtaacaatttaacccacaggaaaaaaaattactttgtatgcttgtttgaaccctatgggttcgttttattaataaaattattacactaatgctaaaaaaaaaa

SEQ ID NO: 372684 - DNA, 1119 bp, Homo sapiens
catatttggctagtggaaaaacaaagaccattcgacacatggtcgccaatgtgcgaggaaaccacatcgcttctgggagcacagacacatggaatgggaaaacgctaaaaatcccacctgttactccatccatcctggattgctgcattatcagagtggactattccttagctgtatacattcacattcctggtgctaaaaaattgatgctcgaactgccattagtgatcggtacaattccatataatggttttggcagcagaaactccagcattgccagccagttcagtatggatatgagctggttgacactgaccctgccagagcagcctgaagcaccaccaaattatgcagatgtggtatcagaggaagaattctctagacacattcctccttaccctcaaccccctaactgtgagggagaagtgtgctgtcctgtgtttgcctgtatacaagaattccggtttcaacccccacctctttattcagaggttgacccacatcctagcgacgtagaagagagccagcctgtttccttcattctctgaacgtatttcagaaatcactgtgttcatcatcaaattagaatgttggttcttttccttctgcctttttgggaaagagacaggaaagattcacttgaaaacataaatgaacgtcaagactgaaggcaatagaaattaaagaatgtgagaaagttctggtgggccggcaggattgccgcacaagtttatatgatggtcgtatatatatccctgttaaaaactgggatgaagatgtgcaaagtcacagaatgtaatggaagtcctgatggttacagagtaagtgaaagggtgcctgcgctgacgtgagagaaaggaatctgtaaacagtggaaacactgtgggagtttcccatggtgttttgaagagtggaacgaaggcgatatgaactgaaggggtgaagacttgattttggagagggcaacaaaacaagggtgtgtgtgcataggagaatggcccactccaaatacgaagtgagatcctgagtctttgggtgcttcatgatttcctaccatattcaggcctaaagacattgaaaaagcatctcaaataaaaggaacattttttttccctcttt

SEQ ID NO: 372685 - DNA, 470 bp, Homo sapiens
ctactactactaaattcgcggccgcgtcgacgccactgccccgacagggggtcaagagaacctactctgaggtgagtgtccaggtcacctagtttggggccttgggtaccaactccctcacccaggcactctttagagctgtggtaaagagcaggcttctggctgggcatggtggctcacgcctgtagtccctgcactttgggaaaccaaggagggtggatcccttgagctcaggagtttgagaccagcctgggcaacatggcgaaaccgtgtctctacaaaaattagcctggtgtggtggcatgtggctgtagtcatagctacttgggaggcagaggtgggaggatcgcctgaacccagaaagttgagggtgcagttagctgtgatcgctcccctgcacttcaggctgggcaacagggtctcactcctgttgtcgacgcggccgcgaatttagtagtagtaggggccgc

SEQ ID NO: 372686 - DNA, 979 bp, Homo sapiens
gcgtgggagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagccactgcatctgttggctcagggccccagcctgtgcaagcagggcgcctgggctgttgtgtctcctgtctgtgccgatctctattaaaggactccctcttgaaaaaaaaaaaatataaaagagaataaaaataaaaaaataaaaaaaaaagaaaaagaagagaaaaaaaaaggaaaaaaaaaagaaaaaaaagaagaaaaaaaacaagataaaaagaaacaaagaagaaggaaaaaggaaaaaagaacagaaaggaaataaagagaaagaagagacagatcacagtagaaataggggagcagcaccataattaggaagatagagaagtaaatataagataacacaataaaaagatgaacaagaagggagagagaagaagaagtagataatgagtacaagtagaagaagcggacaagaaaaataacgtaagaaaagaaggagagtagggctaaaaaaacaagaaagataagtcaaatgaaaagcggaagatataagaagacaggagagagagagagaaaatgttaaagatagaaagaggagagaggaggaaagaaacagagacgaggaggagccgcaggcgaaaccggagcagagcaacacacaacgccaggggacgggacggaagggcataggaggggcagagggagacacaggggctggcagggagcatgaaagcaaagcgaagcacgacaggcgtacgaaccagaggcgcggggagaacgaaaagacgcggcgaacgacaggacgggggaagagcggaaaaggagaaggggaggagagcggacgggacggccgaagaggaagaccgggcagcgacagcgggtagtaggggcggggggggggg

SEQ ID NO: 372687 - DNA, 3815 bp, Homo sapiens
agccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataaggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcaagcagggcgcctgggctgttgtgtctcctgtctgtgccgatctctattaaaggactccctcttg

SEQ ID NO: 372688 - DNA, 4088 bp, Homo sapiens
agccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtggggtagggggcctggccgggaggatgggccgggaggctcacagggtgggcatatggagagagggcgaccgggcaggcacccctggggccgcctcctgtccacctctgttatcatggttcccagtgggtgcgccgtgaacagactccactcccatccaccctggcaatctgccttgactgtttgtgctcaaccctacagcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcaagcagggcgcctgggctgttgtgtctcctgtctgtgccgatctctattaaaggactccctcttg

SEQ ID NO: 372689 - DNA, 4106 bp, Homo sapiens
agccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataaggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcaagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaggtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgcc

SEQ ID NO: 372690 - DNA, 4242 bp, Homo sapiens
agccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataaggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcaagcagggcgcctgggctgttgtgtctcctgtctgtgccgatctctattaaaggactccctcttggtgggcaaaaaaaaaaaaaaaaaaaaaaaaaaaaaaaaaaaaagggggggggggaaaaaaaatacccccgcggggggccacgagtcatcagcagcggctcccgcgtgcctggggaaagagaggggccccaatatagggaggccggtttaatagaagaagggagcggggcgcggcggttatacaccacgcgggaagggggaacaaccgcgctaggcgtggggagacctctggggaaggcagacctaaccatggggggggggccacattgtggacccaacactcctaaagagaaattaaaaagcctacagcgaaacatagaacttgcgaggtgcatacggggggcaaccacacctgagcattagctggcgacagaaagttagggacccgggacgttaatcagggcaatactaccggggcagatataaaa

SEQ ID NO: 372691 - DNA, 4276 bp, Homo sapiens
agccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtgggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggaatgtcccaaggccaattcccttggcagcaatgagaagaaatgcccttttccaaatagcgacttctgcaaaacccgctgttgtttgtgggtggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcaagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaggtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgcc

SEQ ID NO: 372692 - DNA, 2331 bp, Homo sapiens
gtccagtcttcctgccctacccccaagggtgaccatcgttagcatctgtctttgcagaaatactctgtacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcaagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaggtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgcc

SEQ ID NO: 372693 - DNA, 4206 bp, Homo sapiens
agccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtgggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggaatgtcccaaggccaattcccttggcagcaatgagaagaaatgcccttttccaaatagcgacttctgcaaaacccgctgttgtttgtgggtggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcaagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaggtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgcc

SEQ ID NO: 372694 - DNA, 2024 bp, Homo sapiens
  misc_feature (12)..(12): n is a, c, g, or t
aacgttaatagnggtggaacactaattgaaacacccctcgggtgttaacaacagcaggcggtacggcggaagttgggatgactgtccctggaccataatagaaactcattctagaagttcaacatgaaactcattctagaagttcaacatgaaaaagttaggaagaacagctccaagcagaaaatcctaggggcatggaattccaccaccagcattcaccttggggcatcacggtggggatccccacgcaggctgatgcacagagggagtgtggagtggctgcactccctcacatcccgtttcctggtggtattgaacagcatgttgccagctgttctggccccagagcaaccttgcagggaggtcccagggggtggcgtgtgcctctttgagcacatgcaggcctatggtggggccccgcacccggcctgtgtgtgaggaggggctgctcagcatccccactgtgcctggagacagggccgggatgtggtgacaggatggtcactcaggtgtggccagtcagtgaccaaagctgctaacagagttcactttgtcctcagctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcaagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaggtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgcc

SEQ ID NO: 372695 - DNA, 2666 bp, Homo sapiens
agccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtgggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggtaagtacagcaggctagccttgaacctcagatgaccctgggcatatggctcctctccccagatcagtctcctcacctgcaagaatgtggctatgcaggtcacacacctaggttatcagtgttgccacacaaaacaatgacccggggcacctccagcccctcccatctcagggacgtggcggtgaaggcacagtctcagctatggtcccaggaaacagacagtggggctccacccttccttccccgtttggattaaggggctcctggctggaacacctcacaggactggccccatctggggccccctctgggacccacctcacacgcgtggtgtattccgcgctggtatttccgaagatc

SEQ ID NO: 372696 - DNA, 1764 bp, Homo sapiens
agccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtggggtagggggcctggccgggaggatgggccgggaggctcacagggtgggcatatggagagagggcgaccgggcaggcacccctggggccgcctcctgtccacctctgttatcatggttcccagtgggtgcgccgtgaacagactccactcccatccaccctggcaatctgccttgactgtttgtgctcaaccctacagcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggtaagtctgtccactcttgggacagcggggtgacaaggccagggtgggcatgggggaatcacaggactccagagagtcctgtaggagcttgggggacaggggatggctgccatatccctaagaaaagggctgggtgtggtggctcacacttgtaatcccagcaccttcggaggctgagcacaagagttcaaggttaccgtgagtgtgatcttgccactgcacttcaacctgggtcccaaagcaagaccctgtcttaaaaaaaaa

SEQ ID NO: 372697 - DNA, 1389 bp, Homo sapiens
agccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtggggtagggggcctggccgggaggatgggccgggaggctcacagggtgggcatatggagagagggcgaccgggcaggcacccctggggccgcctcctgtccacctctgttatcatggttcccagtgggtgcgccgtgaacagactccactcccatccaccctggcaatctgccttgactgtttgtgctcaaccctacagcctacccgtcttccacagcctacccgtcttccacagcctacccgtcttccacagccta

SEQ ID NO: 372698 - DNA, 399 bp, Homo sapiens
ccacccttccttccccgtttggattaaggggctcctggctggaacacctcacaggactggccccatctggggccccctctgggacccacctcacacgcgtggtgcgtttgtttgtggctgctcccattcctataacctccgagaccttcactcctaggaatgtcccaaggccaattcccttggcagcaatgagaagaaatgcccttttccaaatagcgacttctgcaaaacccgctgttgtttgtgggtgagcactgcaagtcccacccatgccacagccagcctccctcctggctcctctgccagcggtggccttccccagccctcacccaggccccgactctcctctcacaggttccagcttcctggggcctggaactttccctgagtccttcccac

SEQ ID NO: 372699 - DNA, 3892 bp, Homo sapiens
agccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtgggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcaagcagggcgcctgggctgttgtgtctcctgtctgtgccgatctctattaaaggactccctcttg

SEQ ID NO: 372700 - DNA, 3546 bp, Homo sapiens
tgtggcattctgaccagtgcaggagcagctcctggggtttgggatccagttccgaaaggaccctctacaagattcatatatctcaggggtatcctgtgcagggagcagcaggtgggtacccaaaacatttgaatgttctttatggaaaagtgtcattccttctacttgctgcagagaaatccattgagaggacaggccctcgctgctggccatgtaccctttctgggtgcatgggcagagctaacctccctgggagcctgggtgcgccgggtggtgcagcttgggggaggagaggaggagggcttagcgtgcttttgtcttttcagcccctccaacctgtttgatcattttcctctgtggctatgattgctttaagtagtgttacttgtagattatttggaaaatacaagagagtgtaaagaagaccgtgtatggtgggcttctagggtcaggtccagggggcccggcaggggtcaggttggagccccaggtgcatgcagttttctctcccgcagcccacagagcagttcaacgggcagggcgccagcttcaacgggggcagcgtcagctacagccaacctggcctgagtggggtagggggcctggccgggaggatgggccgggaggctcacagggtgggcatatggagagagggcgaccgggcaggcacccctggggccgcctcctgtccacctctgttatcatggttcccagtgggtgcgccgtgaacagactccactcccatccaccctggcaatctgccttgactgtttgtgctcaaccctacagcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcaagcagggcgcctgggctgttgtgtctcctgtctgtgccgatctctattaaaggactccctcttg

SEQ ID NO: 372701 - DNA, 4499 bp, Homo sapiens
agccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataaggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcaagcagggcgcctgggctgttgtgtctcctgtctgtgccgatctctattaaaggactccctcttgaaaaaaaaaaaaaaaaacaacaaacaaggagggcgggcgagccacctaggaaagaaccacccacgaggagcggaccacaaggctagcgcgcggacaccgcgagttaacaggagtagccacagaggggggccccacataagggagcagcgcgacgtatagaacggcgcagaagacagagagtgcgccgtaactgattctgtgcacaattgttgtttgttatgcgtgtggggcaacagcggtgccaatcactggggggggcatctctttcagtgcgtcagacagataacacgcctagtaaaagaattctgtgaaggagtgagacacccatattatgggagaaccaaaaatactagcacgtaagaggacgacaacttatgtgagacccgagtttctatctggagggtgaaaaccatagttcgaggaagtctgtaagacacagtgtcgcaatcaatgcatgggtgaggtgaaaaagacgttatcggagtcgggcacccgagtaccgggctagccgcgctggcgacggaaaccacgaattgagccgacgtacacagagagcgacacgcagccgcaaatatggcaacgcgcacgagcgccgctccgcacacaccacctatccgagcaccacaaacacactatatctcccaaacccgacgaaggcacacactctaacagcccccaacacag

SEQ ID NO: 372702 - DNA, 2952 bp, Homo sapiens
agaagtgtatggttcccaactgtactaagtaggtgagaagctgaagtcctcaagtgttcatcttccaacttttcccagtctgtggtctgtctttggatcagcaataattgcctgaacagctactatggcttcgttgatttttgtctgtagctctctgagctcctctatgtgcagcaaccgcagaatttgagcagcttcattaagaactgcatctcctgtgtcaaaaccaagaatatgtttgtctaaagcaacaggtaagccctcttttgtttgatttgccttagcaactgcatcctgtgtcaggcgctcctgaaccaaaatccgaattgccttaagcattaccaggtaatcatcatgacactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcaagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaggtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgcc

SEQ ID NO: 372703 - DNA, 3880 bp, Homo sapiens
agccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtgggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcaagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaggtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgcc

SEQ ID NO: 372704 - DNA, 3566 bp, Homo sapiens
agccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtgggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtgtctcctgtctgtgccgatctctattaaaggactccctcttg

SEQ ID NO: 372705 - DNA, 2610 bp, Homo sapiens
agccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtgggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctggtttttggatcagctagtacggaccacgtttgtagcatggcacagtcgtgggatagcggcggtgaaactttttgcgcacccatcgcaggggagtacgtcgtagacggcgtgacggccgggttctcatcagatgcatcaagttgaccccacgcatagttgacttggatagattgattcggcgtcgctcctttagagaccacaagagaagacgttggcttaaaaatattgtccttcaagacattaaagaacaggaagaggagggagaaagtgatagcgaagcagcaacgcaggagacgtcaaagagagaaataactcagagagagacagtagaagtacaggtagacaggcgacgacaacgcgcaga

SEQ ID NO: 372706 - DNA, 1811 bp, Homo sapiens
agccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtggggtagggggcctggccgggaggatgggccgggaggctcacagggtgggcatatggagagagggcgaccgggcaggcacccctggggccgcctcctgtccacctctgttatcatggttcccagtgggtgcgccgtgaacagactccactcccatccaccctggcaatctgccttgactgtttgtgctcaaccctacagcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggtgagctccgcctggcccccacctgacccccacgaggctctgttcctcctcggtggaggaggaagccactgcatctgttggctcagggccccagcctgtgcaagcagggcgcctgggctgttgtgtctcctgtctgtgccgatctctattaaaggactccctcttg

SEQ ID NO: 372707 - DNA, 430 bp, Homo sapiens
  misc_feature (1)..(1): n is a, c, g, or t
ncggtaccggtgtatccaccggcaggtgtactccaccggcaggtgtactcaggaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggtgagctccgcctggcccccacctgacccccacgaggctctgttcctcctcggtggaggaggaagccactgcatctgttggctcagggccccagcctgtgcaagcagggcgcctgggctgttgtgtctcctgtctgtgccgatctctattaaaggactccctcttg

SEQ ID NO: 372708 - DNA, 1560 bp, Homo sapiens
acgtcatttcggggcgaccctcttcttggcgtagagttttcagattgctcttgggaaccatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactatgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggctttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataaccaggcctttttctaagccctagactagaggcaagcatttagatcaggaggcaaagtaatttcttgattacatagacggattcctatttatgccctagcagaaggctttacgttgtttcccattgattctcctacattcagtgaggtctttaactgagtccatttaacttgctttcttttttttttttttttttgagatagagtcttgctctttcgcccaggatggagtgcagtggtgcgatctcggctcactgcaacctccgcctcccgggttcaggcagttctcctgcctcagcctcctgagtagctgggattacaggcatgtgccaccacgcctgggcaacatggtgaaaccctgtctctactaaaatacaaaagaaattagccaggtgtggcggcatacccctgtggtcacggctacttgggaggcagaggcaggagaattgcttgaactcgggaggtggaggttgcagtgagctgagattgcaccactgtactccagcactctagcctgggcgacagagtgagactctgtctctacaaaaaaaaaaaaaaaaaaaagtaacccaagggagggagctaccctctagtcgggcagctgatactgcttccttgcatggatacatgggagggagacgttatagattaagaaatgatagcaagataaacaaaatgatttgttgggtatcttttactttacatttgttatttgcagaggagtgttgtatatatagatgttattttatgtcacactgcttcaatgatacctatatccatgtgtttgtatccatgtttttatccattcaactgtattaaaaagtgttgggacagg

SEQ ID NO: 372709 - DNA, 2303 bp, Homo sapiens
acgtcatttcggggcgaccctcttcttggcgtagagttttcagattgctcttgggaaccatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactatgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggctttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataaccaggcctttttctaagccctagactagaggcaagcatttagatcaggaggcaaagtaatttcttgattacatagacggattcctatttatgccctagcagaaggctttacgttgtttcccattgattctcctacattcagtgaggtctttaactgagtccatttaacttgctttcttttttttttttttttttgagatagagtcttgctctttcgcccaggatggagtgcagtggtgcgatctcggctcactgcaacctccgcctcccgggttcaggcagttctcctgcctcagcctcctgagtagctgggattacaggcatgtgccaccacgcctggctaatttttgtatttttagtagagacgggttccaccgtgttggccaggctggtctccaactcctgacctcaaatgatccacccacctaggcctcccaaagtgctgggattacaggagtgagccaccgtgcccagccttgccctgctttctaggagatggagttttctgaatttttctgtatttaggttttctgtactattttttgtccacttgatgcaaacttcttcagctgtgtagaaactttatgaatagatgagtgcttgagtgtctccagtctctaaagtggctgcttttattctttcttcaaagttaataacatgttgcaagatttttggacaaaatattatggtgtgtcataggaaaagcaccatgaattatatttaggtatagcaagtcagatcctttgaagtgactctgtctctgttcttagaagggttcttggaattggctgtggtttgaatctttctactgtcagaggagacccattaaaagccagaatctgcataaagctttctttacttcaaacactgaagctgtaggcgagccatcccgtatcgactttatactcaaagaaggaaaagccagattgcagtgagtgggtaggacagctcagatccaaatgaaagtagggtctcaagtaacccaagggtggccgggtacggtggctcacgcctgtagtcctagcagtttgggaggcagaggtgggcagattgcctgagctcaggagtttgagaccagcctgggcaacatggtgaaaccctgtctctactaaaatacaaaagaaattagccaggtgtggcggcatacccctgtggtcacggctacttgggaggcagaggcaggagaattgcttgaactcgggaggtggaggttgcagtgagctgagattgcaccactgtactccagcactctagcctgggcgacagagtgagactctgtctctacaaaaaaaaaaaaaaaaaaaagtaacccaagggagggagctaccctctagtcgggcagctgatactgcttccttgcatggatacatgggagggagacgttatagattaagaaatgatagcaagataaacaaaatgatttgttgggtatcttttactttacatttgttatttgcagaggagtgttgtatatatagatgttattttatgtcacactgcttcaatgatacctatatccatgtgtttgtatccatgtttttatccattcaactgtattaaaaagtgttgggacagg

SEQ ID NO: 372710 - DNA, 961 bp, Homo sapiens
acgtcatttcggggcgaccctcttcttggcgtagagttttcagattgctcttgggaaccatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactatgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggctttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataaccaggcctttttctaagccctagactagaggcaagcatttagatcaggaggcaaagtaatttcttgattacatagacggattcctatttatgccctagcagaaggctttacgttgtttcccattgattctcctacattcagtgaggtctttaactgagtccatttaacttgctttctttttggaacctgctttccaaaaaaaaaaaaaggcccggggggggcccctaggggga

SEQ ID NO: 372711 - DNA, 2329 bp, Homo sapiens
ccgcgacgcgccacagacacacacagacccgcgcggaccttgctgtgagccgctgttatcggagaggagattgctcttgggaaccatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactatgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggctttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataaccaggcctttttctaagccctagactagaggcaagcatttagatcaggaggcaaagtaatttcttgattacatagacggattcctatttatgccctagcagaaggctttacgttgtttcccattgattctcctacattcagtgaggtctttaactgagtccatttaacttgctttcttttttttttttttttttgagatagagtcttgctctttcgcccaggatggagtgcagtggtgcgatctcggctcactgcaacctccgcctcccgggttcaggcagttctcctgcctcagcctcctgagtagctgggattacaggcatgtgccaccacgcctggctaatttttgtatttttagtagagacgggttccaccgtgttggccaggctggtctccaactcctgacctcaaatgatccacccacctaggcctcccaaagtgctgggattacaggagtgagccaccgtgcccagccttgccctgctttctaggagatggagttttctgaatttttctgtatttaggttttctgtactattttttgtccacttgatgcaaacttcttcagctgtgtagaaactttatgaatagatgagtgcttgagtgtctccagtctctaaagtggctgcttttattctttcttcaaagttaataacatgttgcaagatttttggacaaaatattatggtgtgtcataggaaaagcaccatgaattatatttaggtatagcaagtcagatcctttgaagtgactctgtctctgttcttagaagggttcttggaattggctgtggtttgaatctttctactgtcagaggagacccattaaaagccagaatctgcataaagctttctttacttcaaacactgaagctgtaggcgagccatcccgtatcgactttatactcaaagaaggaaaagccagattgcagtgagtgggtaggacagctcagatccaaatgaaagtagggtctcaagtaacccaagggtggccgggtacggtggctcacgcctgtagtcctagcagtttgggaggcagaggtgggcagattgcctgagctcaggagtttgagaccagcctgggcaacatggtgaaaccctgtctctactaaaatacaaaagaaattagccaggtgtggcggcatacccctgtggtcacggctacttgggaggcagaggcaggagaattgcttgaactcgggaggtggaggttgcagtgagctgagattgcaccactgtactccagcactctagcctgggcgacagagtgagactctgtctctacaaaaaaaaaaaaaaaaaaaagtaacccaagggagggagctaccctctagtcgggcagctgatactgcttccttgcatggatacatgggagggagacgttatagattaagaaatgatagcaagataaacaaaatgatttgttgggtatcttttactttacatttgttatttgcagaggagtgttgtatatatagatgttattttatgtcacactgcttcaatgatacctatatccatgtgtttgtatccatgtttttatccattcaactgtattaaaaagtgttgggacagg

SEQ ID NO: 372712 - DNA, 1989 bp, Homo sapiens
aatatgtaaataaaaacattggcacttttaaataggtcatcctgtcccaaagaggtagtgtttcccccaatacccacagcccctcacacaggcgtgtgcgcacacactcacggctcatggatcctgttttggtgaaccggactgacttcttcttgcctgccactccaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataaccaggcctttttctaagccctagactagaggcaagcatttagatcaggaggcaaagtaatttcttgattacatagacggattcctatttatgccctagcagaaggctttacgttgtttcccattgattctcctacattcagtgaggtctttaactgagtccatttaacttgctttcttttttttttttttttttgagatagagtcttgctctttcgcccaggatggagtgcagtggtgcgatctcggctcactgcaacctccgcctcccgggttcaggcagttctcctgcctcagcctcctgagtagctgggattacaggcatgtgccaccacgcctggctaatttttgtatttttagtagagacgggttccaccgtgttggccaggctggtctccaactcctgacctcaaatgatccacccacctaggcctcccaaagtgctgggattacaggagtgagccaccgtgcccagccttgccctgctttctaggagatggagttttctgaatttttctgtatttaggttttctgtactattttttgtccacttgatgcaaacttcttcagctgtgtagaaactttatgaatagatgagtgcttgagtgtctccagtctctaaagtggctgcttttattctttcttcaaagttaataacatgttgcaagatttttggacaaaatattatggtgtgtcataggaaaagcaccatgaattatatttaggtatagcaagtcagatcctttgaagtgactctgtctctgttcttagaagggttcttggaattggctgtggtttgaatctttctactgtcagaggagacccattaaaagccagaatctgcataaagctttctttacttcaaacactgaagctgtaggcgagccatcccgtatcgactttatactcaaagaaggaaaagccagattgcagtgagtgggtaggacagctcagatccaaatgaaagtagggtctcaagtaacccaagggtggccgggtacggtggctcacgcctgtagtcctagcagtttgggaggcagaggtgggcagattgcctgagctcaggagtttgagaccagcctgggcaacatggtgaaaccctgtctctactaaaatacaaaagaaattagccaggtgtggcggcatacccctgtggtcacggctacttgggaggcagaggcaggagaattgcttgaactcgggaggtggaggttgcagtgagctgagattgcaccactgtactccagcactctagcctgggcgacagagtgagactctgtctctacaaaaaaaaaaaaaaaaaaaagtaacccaagggagggagctaccctctagtcgggcagctgatactgcttccttgcatggatacatgggagggagacgttatagattaagaaatgatagcaagataaacaaaatgatttgttgggtatcttttactttacatttgttatttgcagaggagtgttgtatatatagatgttattttatgtcacactgcttcaatgatacctatatccatgtgtttgtatccatgtttttatccattcaactgtattaaaaagtgttgggacagg

SEQ ID NO: 372713 - DNA, 1448 bp, Homo sapiens
ttaatatccagactgtataaggaattcaaactcaatagcaaaaactcaatccgatttttttttttttgagatagagtcttgctctttcgcccaggatggagtgcagtggtgcgatctcggctcactgcaacctccgcctcccgggttcaggcagttctcctgcctcagcctcctgagtagctgggattacaggcatgtgccaccacgcctggctaatttttgtatttttagtagagacgggttccaccgtgttggccaggctggtctccaactcctgacctcaaatgatccacccacctaggcctcccaaagtgctgggattacaggagtgagccaccgtgcccagccttgccctgctttctaggagatggagttttctgaatttttctgtatttaggttttctgtactattttttgtccacttgatgcaaacttcttcagctgtgtagaaactttatgaatagatgagtgcttgagtgtctccagtctctaaagtggctgcttttattctttcttcaaagttaataacatgttgcaagatttttggacaaaatattatggtgtgtcataggaaaagcaccatgaattatatttaggtatagcaagtcagatcctttgaagtgactctgtctctgttcttagaagggttcttggaattggctgtggtttgaatctttctactgtcagaggagacccattaaaagccagaatctgcataaagctttctttacttcaaacactgaagctgtaggcgagccatcccgtatcgactttatactcaaagaaggaaaagccagattgcagtgagtgggtaggacagctcagatccaaatgaaagtagggtctcaagtaacccaagggtggccgggtacggtggctcacgcctgtagtcctagcagtttgggaggcagaggtgggcagattgcctgagctcaggagtttgagaccagcctgggcaacatggtgaaaccctgtctctactaaaatacaaaagaaattagccaggtgtggcggcatacccctgtggtcacggctacttgggaggcagaggcaggagaattgcttgaactcgggaggtggaggttgcagtgagctgagattgcaccactgtactccagcactctagcctgggcgacagagtgagactctgtctctacaaaaaaaaaaaaaaaaaaaagtaacccaagggagggagctaccctctagtcgggcagctgatactgcttccttgcatggatacatgggagggagacgttatagattaagaaatgatagcaagataaacaaaatgatttgttgggtatcttttactttacatttgttatttgcagaggagtgttgtatatatagatgttattttatgtcacactgcttcaatgatacctatatccatgtgtttgtatccatgtttttatccattcaactgtattaaaaagtgttgggacagg

SEQ ID NO: 372714 - DNA, 978 bp, Homo sapiens
aggtgacactatagacaatttgtacaaaaacaggcggtacggtccggaattcccgggaagattgctcttgggaaccatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactatgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggctttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataaccaggcctttttctaagccctagactagaggcaagcatttagatcaggaggcaaagtaatttcttgattacatagacggattcctatttatgccctagcagaaggctttacgttgtttcccattgattctcctacattcagtgaggtctttaactgagtccatttaacttgctttctttttggaacctgctttccaaaaaaaaaaaaaggcccggggggggcccctaggggga

SEQ ID NO: 372715 - DNA, 2020 bp, Homo sapiens
acgtcatttcggggcgaccctcttcttggcgtagagttttcagattgctcttgggaaccatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactatgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggctttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataaccaggcctttttctaagccctagactagaggcaagcatttagatcaggaggcaaagtaatttcttgattacatagacggattcctatttatgccctagcagaaggctttacgttgtttcccattgattctcctacattcagtgaggtctttaactgagtccatttaacttgctttcttttttttttttttttttgagatagagtcttgctctttcgcccaggatggagtgcagtggtgcgatctcggctcactgcaacctccgcctcccgggttcaggcagttctcctgcctcagcctcctgagtagctgggattacaggcatgtgccaccacgcctggctaatttttgtatttttagtagagacgggttccaccgtgttggccaggctggtctccaactcctgacctcaaatgatccacccacctaggcctcccaaagtgctgggattacaggagtgagccaccgtgcccagccttgccctgctttctaggagatggagttttctgaatttttctgtatttaggttttctgtactattttttgtccacttgatgcaaacttcttcagctgtgtagaaactttatgaatagatgagtgcttgagtgtctccagtctctaaagtggctgcttttattctttcttcaaagttaataacatgttgcaagatttttggacaaaatattatggtgtgtcataggaaaagcaccatgaattatatttaggtatagcaagtcagatcctttgaagtgactctgtctctgttcttagaagggttcttggaattggctgtggtttgaatctttctactgtcagaggagacccattaaaagccagaatctgcataaagctttctttacttcaaacactgaagctgtaggcgagccatcccgtatcgactttatactcaaagaaggaaaagccagattgcagtgagtgggtaggacagctcagatccaaatgaaagtagggtctcaagtaacccaagggtggccgggtacggtggctcacgcctgtagtcctagcagtttgggaggcagaggtgggcagattgcctgagctcaggagtttgagaccagcctgggcaacatggtgaaaccctgtctctactaaaatacaaaagaaattagccaggtgtggttcaagcgattctcctgcctcagcctcccaagtagctgggattacaggcacccgccaccatgcctagctaatttttgtatttttagtagagacggagtttcaccgtgttggccaggctggtcttgaactcctgagctcaggtgatccacctgcc

SEQ ID NO: 372716 - DNA, 2776 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372717 - DNA, 446 bp, Homo sapiens
taactcggccctcttctccgaaaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaaggtgctcgtggtcaatccacgaaggcccggcagggcagccctggggctcagtgtgctcccttcccatactgtgcctgtcagacctggggaggcactagcttttaggaagcagagc

SEQ ID NO: 372718 - DNA, 226 bp, Homo sapiens
gcggccgcctactactactactaccactgctcgaattcaagcttctaacgatgtacggggacctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372719 - DNA, 2658 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacgcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372720 - DNA, 2485 bp, Homo sapiens
aattaggctaggtagagcctggtgttgaatcggcaccgagactatggaacgtcaggtgagggctcggcccgcggtccccgtggtccctgcagcccgggccgggcctgaccctggtgtgtcccctgcgcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372721 - DNA, 2778 bp, Homo sapiens
taaaaagaaaggccttacatatttattactgaatccagccaaccaagcgggttcataacagaattcagagaaggaaaacacgtcgaaatctccaaaataggggtgacattttcagctgtgattatggtaacatgatcgtgaccttcagaacagcataaatatgtgtgccatctcagtggtgcaatctccttatagacccagctgggttcttctccaagtgtctcctttgggagttgtcacctgatttatattcttccagttttcatccgaatccacgggggaaggggacgatttggctttggtttctgggccaggaatcgcttaactcctgaaagtctgggtgagaagactgtggcgagcagcggagctcaaagaacacaccacgagtggcggagaaaggaagagagactatggaacgtcagggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372722 - DNA, 2649 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372723 - DNA, 2093 bp, Homo sapiens
taactcggccctcttctccgaaaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372724 - DNA, 2638 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372725 - DNA, 2642 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggcatatggcatcaaggctgggcctaacccagtctcatgaccttgtgaatccagtccacaaacacagagacacgcgtgaagacagctggccagcgggaccttgcgcatactcggttggggattataattccttccaggacc

SEQ ID NO: 372726 - DNA, 3484 bp, Homo sapiens
  misc_feature (3001)..(3002): n is a, c, g, or t
aattaggctaggtagagcctggtgttgaatcggcaccgagactatggaacgtcaggtgagggctcggcccgcggtccccgtggtccctgcagcccgggccgggcctgaccctggtgtgtcccctgcgcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcacgtcacagccgagctgcgtgacgtggaggacaagtacgcagagtgcatggagatgctgcatgaggcgcaggaagtgagctgaagaacctccgaacaaaccatgccaataccacgtctcgtcgcatccactcactgggcctgtttccatggattcttggcagcagagattgagggaacgatgcgcaaggagctgcagttggaagaggccgagtctcagacatcactcaccagaagcgtgtctttgagacagtaagaacatcacagtgtcagcagagatctctgacccttttccatgaacanncccggctccaaccagtcctcggccatgaactccctcctgtccagctgcgtccatccccccggtccagcttctacggcagcgacataggcaacgtcgtcctcgacaacaagaccaacagcatcattctggaaacagaggcagccgacctgggaaacgatgagcggagtaagaagccggggacgccggcaccccaggctcccacgacctggagacggcgctgaggcgctgtcctgcgccgggagaactacctctcggagaggaggttctttgaggaggagcaagagaggaagctccaggagctggcggagaagggcgagtgcgcagcggctccctcacacccactgagagcatcatgtccctgggcacgcactcccgcttctccgagttcaccggcttctctggatgtccttcagcagccgctcctacctacctgcctgagaagctccagatcgtgaagccgctgctggcaaggttccgccacc

SEQ ID NO: 372727 - DNA, 2347 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372728 - DNA, 2060 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372729 - DNA, 1060 bp, Homo sapiens
  misc_feature (7)..(7): n is a, c, g, or t
ccagtgnggcatgcagctggtacaccgtgagggcagagcttgtggaggttgatgtagacgttgaccagcaggtcaccagtggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372730 - DNA, 1714 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcagggacctgttttgcttgtgggacaacccaagtgggcactggtgacctcccttcacaagttggaggggtcacaggtgggaactggaaattgtcacacattggcacagaactcatgggggccagattacacaacccaattactcaaaccg

SEQ ID NO: 372731 - DNA, 972 bp, Homo sapiens
ataggcatagtagagctggtgtgaatcggccgagggtcatatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372732 - DNA, 1192 bp, Homo sapiens
  misc_feature (12)..(12): n is a, c, g, or t
  misc_feature (14)..(14): n is a, c, g, or t
  misc_feature (20)..(23): n is a, c, g, or t
  misc_feature (29)..(29): n is a, c, g, or t
  misc_feature (31)..(31): n is a, c, g, or t
gacgaggctatngnggctcnnnnggcttngncccattcatccttgtcactgcctggatgctgttcccagccatgcttgcaagatgggcttgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacgcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372733 - DNA, 601 bp, Homo sapiens
agtataaaccgaacagggggtggtgggaacccaggctgacggtgagggtggtggagtttggacaggagcgcgcgggccggcggggaggcccacagaggcactgttgagccctgcggcctggttgaccagactccagtgaggcgtcagcctgttccactggcagctctgtgacgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372734 - DNA, 1316 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcagactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcagggacctgttttgcttgtgggacaacccaagtgggcactggtgacctcccttcacaagttggaggggtcacaggtgggaactggaaattgtcacacattggcacagaactcatgggggccagattacacaacccaattactcaaaccg

SEQ ID NO: 372735 - DNA, 982 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372736 - DNA, 682 bp, Homo sapiens
tgggcagaagggaagggcagggaggcagccaggccacctatgacacattctttccccttggcagaaagttgggttcctgccttctgcagggaaggagcagtcagtgttgtgggtgtccctggaggaggccgagcccattcccgacatccactggggcatccgggtgctacagccacccccagagcaagagaatgtgcagtatgtggtgagctgggccaggggcagagggatgccttctccaggttccccagcacaaagcctctgcggtgacctttgctacctcctctctcacattgtggggtttctggtgatgacctctaagaggttttctgttcctcttgtggatgggcatgggaagtagcatctagacatctgagcgcctgctctggatatcacctgggcttcaccaggccaaatcatctgtggttggaagacccaggtccaaagaaaataggcctcatacaagcctcagtgaccacacctcatcccgaatgctgttgctgcaggatggggttccctgacgagggcagaagaagtatgagccttctggggtccatgtgtcatggtgtggactaccttggccaggtctctgacccagaggtcagccccacacctgcagctagagatggggccttagttggggaagcccctaggctcaccctgctgactgctgccctctccc

SEQ ID NO: 372737 - DNA, 734 bp, Homo sapiens
ccaggccaaatcatctgtggttggaagacccaggtccaaagaaaataggcctcatacaagcctcagtgaccacacctcatcccgaatgctgttgctgcaggatggggttccctgacgagggcagaagaagtatgagccttctggggtccatgtgtcatggtgtggactaccttggccaggtctctgacccagaggtcagccccacacctgcagctagagatggggccttagttggggaagcccctaggctcaccctgctgactgctgccctctccctgcagcctggccttgactttgaagcaatcctgctgcagcctggcagccctccagataagacccaagtgcccatggtggtcatgccccacgaggcatctggcgttaagagcccttgccctcccagccctcttcctagctggccctttcaccctccgctccctgtctgcaggggggccccattcatcctttgtcactgcctggatgctgttcccagccatgctttgcaagatgggctttgcggtactactaggtgagtgagcagggacccacagttctgttaggactacagtggagtgacgggggtggacctggtttgtataagtaccatgggtgccactctagtctccaggactttctctagcctagacctagtaaccactaccaggaactgctggggcccagcctctggttctgtggcatagtgataacaaggactaactcgggacttccaaggaaag

SEQ ID NO: 372738 - DNA, 2691 bp, Homo sapiens
ggcacgaggctcaaccccttctctcgtaggcccttctaccctccccgaagccgggctcccgggttccgcttccacagggccgccccctctcctccgagatccaacgcctcgcccctcggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372739 - DNA, 3248 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggttcctgctggtactttgtaccaaaccatccccaaccccacctcccactctggggtgcagagaccctaggttctgggtgtggcagccacaagggcttcatctgcctccagtgtgagaagggagggaacagtgagaggcttagcctctgcctgtcctggcaaccaggactctgtaccagcctagcttccctgctgcagccccttccattagcaactactctgtaccacccttcccaagagtatgtctggaggactagtgtgaggccctgtctttccacggcacccatgggcaaaagtagtcccagggacattgccttggttggggaagcccctaggctggacagatcacctagcccagggtgtgctgggctcaagccacccgagccctagcaaggagtcactgacacatttcctggaagcaaaggctaagaagcatctgtacaggcataaagaggaaacaaggcaatatgtctga

SEQ ID NO: 372740 - DNA, 2397 bp, Homo sapiens
taggatacgagcctggatgaaatcggacgaggggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372741 - DNA, 2699 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccaggctttctgggctctggactccacggatgcgtgggcagaggaatgtgggctatgtagtcataataaattaggacacagagcctggt

SEQ ID NO: 372742 - DNA, 2340 bp, Homo sapiens
ggcacgaggctcaaccccttctctcgtaggcccttctaccctccccgaagccgggctcccgggttccgcttccacagggccgccccctctcctccgagatccaacgcctcgcccctcgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372743 - DNA, 2216 bp, Homo sapiens
gcccaggctccgcccccggaagctcacttccgggcgcgagcccgaggaggcggcggctctgtatcggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372744 - DNA, 2255 bp, Homo sapiens
agagggagatctctgccccctggggctgagagaccccaacctttccccaagctgaagctgcagggtattgaggtaccagccagatgtcttcccacaaaggatctgtggtggcacaggggaatggggctcctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372745 - DNA, 2612 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372746 - DNA, 2866 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggtgagtgcagcatgaaggccctggcagctggtgggcaggtgagcacaggaggaccctccaaccttaaatgttgctgactaatccctacaggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372747 - DNA, 2545 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagagcgaagtgtggcacaggctgatcagctcatgcagaatggcagggcttcagctgccgtcgacc

SEQ ID NO: 372748 - DNA, 1893 bp, Homo sapiens
tcaaggaaggtagaggcgcgggttttcggcgtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372749 - DNA, 2069 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372750 - DNA, 1719 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagaggaactcttctgggatcctactgcaggcttctgccttggggatgcctggtcagtgacaggcagcagagtgggctcggattcggttcagacgcaaccggtaaggacctgttggctgtggacccccacatgggcactgggacctggccaaacagtgagggccagctgcaccggaagttgccaccatctggcaggacctctgggcagcaagttccacacccacttacatcaacccagaaacgggatcacaca

SEQ ID NO: 372751 - DNA, 1000 bp, Homo sapiens
  misc_feature (7)..(7): n is a, c, g, or t
agtcaangccagcatactgcaggctgcagcaggattgcttcaaagtcaaggccagcatactgcacattctcctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372752 - DNA, 1381 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagcctgtattatgtggacctcatcggggggggagtgtgagctcctctgggttgactcccggtggtcctcttccggttgacccggacatgttgcttggtaccgggggccattttggtcccttcatgggcgtggc

SEQ ID NO: 372753 - DNA, 709 bp, Homo sapiens
agtataaaccgaacaggcttccacatcaattgtgacctcattctcaacagcgaggcacctaatccgtgcctgatccgtctttgcaacaccaccaatgaccaatatgaaatcaggtccactgacagatgctcaagtgtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggtgagtgcagcatgaaggccctggcagctggtgggcaggtgagcacaggaggaccctccaaccttaaatgttgctgactaatccctacaggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372754 - DNA, 936 bp, Homo sapiens
ggcacgaggctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactggtgtgtgtgcgaaggggaactggagggcatggagtattaccgtgccctcaagacccggaatgtgcctgttcggctcctgctctatcccaaaagcacccacgcattatcagaggtggaggtggagtcagacagcttcatgaatgctggacaaatcgcccatcagatacatccctcaggtgaagacaccactgttactgatgttgggccaggaggaccggctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggt

SEQ ID NO: 372755 - DNA, 1621 bp, Homo sapiens
aaatactaaccacagagggagaggcagcaagaggagaggcataaattcaggatctcacccttcattccacagacacacatagcctctctgcccacctctgcttcctctaggaacacaggagttccagatcacatcgagttcaccatgaattcactcagtgaagccaacaccaagttcatgttcgacctgttccaacagttcagaaaatcaaaagagaacaacatcttctattcccctatcagcatcacatcagcattagggatggtcctcttaggagccaaagacaacactgcacaacagattaagaaggttcttcactttgatcaagtcacagagaacaccacaggaaaagctgcaacatatcatgttgataggtcaggaaatgttcatcaccagtttcaaaagcttctgactgaattcaacaaatccactgatgcatatgagctgaagatcgccaacaagctcttcggagaaaaaacgtatctatttttacaggaatatttagatgccatcaagaaattttaccagaccagtgtggaatctgttgattttgcaaatgctccagaagaaagtcgaaagaagattaactcctgggtggaaagtcaaacgaatgaaaaaattaaaaacctaattcctgaaggtaatattggcagcaataccacattggttcttgtgaacgcaatctatttcaaagggcagtgggagaagaaatttaataaagaagatactaaagaggaaaaattttggccaaacaagcttgaagagaaactcactgctgagaaattgatggaatggacaagtttgcagaatatgagagagacacgtgtcgatttacacttacctcggttcaaagtggaagagagctatgacctcaaggacacgttgagaaccatgggaatggtggatatcttcaatggggatgcagacctctcaggcatgaccgggagccgcggtctcgtgctatctggagtcctacacaaggcctttgtggaggttacagaggagggagcagaagctgcagctgccaccgctgtagtaggattcggatcatcacctacttcaactaatgaagagttccattgtaatcaccctttcctattcttcataaggcaaaataagaccaacagcatcctcttctatggcagattctcatccccgtagatgcaattagtctgtcactccatttggaaaatgttcacctgcagatgttctggtaaactgattgctggcaacaacagattctcttggctcatatttcttttctttctcatcttgatgatgatcgtcatcatcaagaatttaatgattaaaatagcatgcctttctctctttctcttaataagcccacatataaatgtactttttcttccagaaaaattctccttgaggaaaaatgtccaaaataagatgaatcacttaataccgtatcttctaaatttgaaatataattctgtttgtgacctgttttaaatgaaccaaaccaaatcatactttttctttgaatttagcaacctagaaacacacatttctttgaatttaggtgatacctaaatccttcttatgtttctaaattttgtgattctataaaacacatcatcaataaaatagtgacataaaatca

SEQ ID NO: 372756 - DNA, 1534 bp, Homo sapiens
  misc_feature (1520)..(1520): n is a, c, g, or t
aaatactaaccacagagggagaggcagcaagaggagaggcataaattcaggatctcacccttcattccacagacacacatagcctctctgcccacctctgcttcctctaggaacacaggagttccagatcacatcgagttcaccatgaattcactcagtgaagccaacaccaagttcatgttcgacctgttccaacagttcagaaaatcaaaagagaacaacatcttctattcccctatcagcatcacatcagcattagggatggtcctcttaggagccaaagacaacactgcacaacagattaagaaggttcttcactttgatcaagtcacagagaacaccacaggaaaagctgcaacatatcatgttgataggtcaggaaatgttcatcaccagtttcaaaagcttctgactgaattcaacaaatccactgatgcatatgagctgaagatcgccaacaagctcttcggagaaaaaacgtatctatttttacaggaatatttagatgccatcaagaaattttaccagaccagtgtggaatctgttgattttgcaaatgctccagaagaaagtcgaaagaagattaactcctgggtggaaagtcaaacgaatgaaaaaattaaaaacctaattcctgaaggtaatattggcagcaataccacattggttcttgtgaacgcaatctatttcaaagggcagtgggagaagaaatttaataaagaagatactaaagaggaaaaattttggccaaacaagaatacatacaagtccatacagatgatgaggcaatacacatcttttcattttgcctcgctggaggatgtacaggccaaggtcctggaaataccatacaaaggcaaagatctaagcatgattgtgttgctgccaaatgaaatcgatggtctccagaagcttgaagagaaactcactgctgagaaattgatggaatggacaagtttgcagaatatgagagagacacgtgtcgatttacacttacctcggttcaaagtggaagagagctatgacctcaaggacacgttgagaaccatgggaatggtggatatcttcaatggggatgcagacctctcaggcatgaccgggagccgcggtctcgtgctatctggagtcctacacaaggcctttgtggaggttacagaggagggagcagaagctgcagctgccaccgctgtagtaggattcggatcatcacctacttcaactaatgaagagttccattgtaatcaccctttcctattcttcataaggcaaaataagaccaacagcatcctcttctatggcagattctcatccccgtagatgcaattagtctgtcactccatttggaaaatgttcacctgcagatgttctggtaaactgattgctggcaacaacagattctcttggctcatatttcttttctttctcatcttgatgatgatcgtcatcatcaagaatttaatgattaaaatagcatgcctttctctctttctcttaataagcccacaggtagcataccccancaggtagcagtacc

SEQ ID NO: 372757 - DNA, 1777 bp, Homo sapiens
aaatactaaccacagagggagaggcagcaagaggagaggcataaattcaggatctcacccttcattccacagacacacatagcctctctgcccacctctgcttcctctaggaacacaggagttccagatcacatcgagttcaccatgaattcactcagtgaagccaacaccaagttcatgttcgacctgttccaacagttcagaaaatcaaaagagaacaacatcttctattcccctatcagcatcacatcagcattagggatggtcctcttaggagccaaagacaacactgcacaacagattaagaaggttcttcactttgatcaagtcacagagaacaccacaggaaaagctgcaacatatcatgttgataggtcaggaaatgttcatcaccagtttcaaaagcttctgactgaattcaacaaatccactgatgcatatgagctgaagatcgccaacaagctcttcggagaaaaaacgtatctatttttacaggaatatttagatgccatcaagaaattttaccagaccagtgtggaatctgttgattttgcaaatgctccagaagaaagtcgaaagaagattaactcctgggtggaaagtcaaacgaatgaaaaaattaaaaacctaattcctgaaggtaatattggcagcaataccacattggttcttgtgaacgcaatctatttcaaagggcagtgggagaagaaatttaataaagaagatactaaagaggaaaaattttggccaaacaagaatacatacaagtccatacagatgatgaggcaatacacatcttttcattttgcctcgctggaggatgtacaggccaaggtcctggaaataccatacaaaggcaaagatctaagcatgattgtgttgctgccaaatgaaatcgatggtctccagaagcttgaagagaaactcactgctgagaaattgatggaatggacaagtttgcagaatatgagagagacacgtgtcgatttacacttacctcggttcaaagtggaagagagctatgacctcaaggacacgttgagaaccatgggaatggtggatatcttcaatggggatgcagacctctcaggcatgaccgggagccgcggtctcgtgctatctggagtcctacacaaggcctttgtggaggttacagaggagggagcagaagctgcagctgccaccgctgtagtaggattcggatcatcacctacttcaactaatgaagagttccattgtaatcaccctttcctattcttcataaggcaaaataagaccaacagcatcctcttctatggcagattctcatccccgtagatgcaattagtctgtcactccatttggaaaatgttcacctgcagatgttctggtaaactgattgctggcaacaacagattctcttggctcatatttcttttctttctcatcttgatgatgatcgtcatcatcaagaatttaatgattaaaatagcatgcctttctctctttctcttaataagcccacatataaatgtactttttcttccagaaaaattctccttgaggaaaaatgtccaaaataagatgaatcacttaataccgtatcttctaaatttgaaatataattctgtttgtgacctgttttaaatgaaccaaaccaaatcatactttttctttgaatttagcaacctagaaacacacatttctttgaatttaggtgatacctaaatccttcttatgtttctaaattttgtgattctataaaacacatcatcaataaaatagtgacataaaatca

SEQ ID NO: 372758 - DNA, 289 bp, Homo sapiens
tgactctagaggaccccttagggtcatacaactctgcacaacagattaagaaggttcttcactttgatcaagtcacagagaacaccacaggaaaagctgcaacatatcatgttgataggtcaggaaatgttcatcaccagtttcaaaagcttctgactgaattcaacaaatccactgatgcatatgagctgaagatcgccaacaagctcttcggagaaaaaacgtatctatttttacaggaatatttagatgccatcaagaaattttaccaatcctgcgtggaccctaa

SEQ ID NO: 372759 - DNA, 566 bp, Homo sapiens
aaatactaaccacagagggagaggcagcaagaggagaggcataaattcaggatctcacccttcattccacagacacacatagcctctctgcccacctctgcttcctctaggaacacaggagttccagatcacatcgagttcaccatgaattcactcagtgaagccaacaccaagttcatgttcgacctgttccaacagttcagaaaatcaaaagagaacaacatcttctattcccctatcagcatcacatcagcattagggatggtcctcttaggagccaaagacaacactgcacaacagattaagaaggttcttcactttgatcaagtcacagagaacaccacaggaaaagctgcaacatatcatgttgataggtcaggaaatgttcatcaccagtttcaaaagcttctgactgaattcaacaaatccactgatgcatatgagctgaagatcgccaacaagctcttcggagaaaaaacgtatctatttttacagaaatatttagatgccagcaagaaattttaccagaccagtgttggttccagaatggtaatcagcttatcgat

SEQ ID NO: 372760 - DNA, 868 bp, Homo sapiens
gtctaggatgctggggaaatggttctgttcctttgttggtggtttggaacttattgtcaatttactgaaatcagataacaaagaagttctggcaagtgtatgtgctgccattaccaacatagcaaaagatcaagaaaatttagctgttatcacagatcatggagttgttcctttattgtccaaactggcaaatacaaataacaataaattgagacatcatctagcagaagctatttcacgttgctgtatgtggggcaggaatagagtggccttcggtgagcacaaagcagtggctccactagtgcgttatctgaaatcaaatgacaccaacgtgcatcgggcgacagctcaggccttgtaccaactctcagaagacgccgataactgcatcaccatgcatgagaatggtgcagtaaagcttctactggatatggttgggtcccctgaccaggatctccaggaagctgcagctggttgtatatccaatatccgcaggctggctcttgctacagagaaggcaagatacacttgaaatttaaatggacattacaagctatcaaattctacatgacacaggacatgtcactcccatggccagaaagcctaaattgggaaacagttgttagcaaaccctttcaaccatctaaatgaaaacacacaagttgaaaatgcacagaatgtttttcatctgaaaattgcatggagacttttgtttctatttaatgttttcgagatatgacatgtgataagatggaaagccaataaacctgtgataagtttctaagaatatgagaatatacgtatatgatgtatttttagttcagtgatgcttttgtatttgtggcgattttaataaaggatatggcct

SEQ ID NO: 372761 - DNA, 924 bp, Homo sapiens
gtctaggatgctggggaaatggttctgttcctttgttggtggtttggaacttattgtcaatttactgaaatcagataacaaagaagttctggcaagtgtatgtgctgccattaccaacatagcaaaagatcaagaaaatttagctgttatcacagatcatggagttgttcctttattgtccaaactggcaaatacaaataacaataaattgagacatcatctagcagaagctatttcacgttgctgtatgtggggcaggaatagagtggccttcggtgagcacaaagcagtggctccactagtgcgttatctgaaatcaaatgacaccaacgtgcatcgggcgacagctcaggccttgtaccaactctcagaagacgccgataactgcatcaccatgcatgagaatggtgcagtaaagcttctactggatatggttgggtcccctgaccaggatctccaggaagctgcagctggttgtatatccaatatccgcaggctggctcttgctacagagaaggcaagatacacttgaaatttaaatggacattacaagctatcaaattctacatgacacaggacatgtcactcccatggccagaaagcctaaattgggaaacagttgttagcaaaccctttcaaccatctaaatgaaaacacacaagttgaaaatgcacagaatgtttttcatctgaaaattgcatggagacttttgtttctatttaatgttttcgagatatgacatgtgataagatggaaagccaataaacctgtgataagtttctaagaatatgagaatatacgtatatgatgtatttttagttcagtgatgcttttgtatttgtggcgattttaataaaggatatggcctggtagatgcggccgcccccccattatatactcctcaccacctccctatataaagac

SEQ ID NO: 372762 - DNA, 904 bp, Homo sapiens
  misc_feature (895)..(895): n is a, c, g, or t
  misc_feature (904)..(904): n is a, c, g, or t
gtctaggatgctggggaaatggttctgttcctttgttggtggtttggaacttattgtcaatttactgaaatcagataacaaagaagttctggcaagtgtatgtgctgccattaccaacatagcaaaagatcaagaaaatttagctgttatcacagatcatggagttgttcctttattgtccaaactggcaaatacaaataacaataaattgagacatcatctagcagaagctatttcacgttgctgtatgtggggcaggaatagagtggccttcggtgagcacaaagcagtggctccactagtgcgttatctgaaatcaaatgacaccaacgtgcatcgggcgacagctcaggccttgtaccaactctcagaagacgccgataactgcatcaccatgcatgagaatggtgcagtaaagcttctactggatatggttgggtcccctgaccaggatctccaggaagctgcagctggttgtatatccaatatccgcaggctggctcttgctacagagaaggcaagatacacttgaaatttaaatggacattacaagctatcaaattctacatgacacaggacatgtcactcccatggccagaaagcctaaattgggaaacagttgttagcaaaccctttcaaccatctaaatgaaaacacacaagttgaaaatgcacagaatgtttttcatctgaaaattgcatggagacttttgtttctatttaatgttttcgagatatgacatgtgataagatggaaagccaataaacctgtgataagtttctaagaatatgagaatatacgtatatgatgtatttttagttcagtgatgcttttgtatttgtggcgattttaataaaggatatggcctcgttggcctcagcggtggagctcgtcnggacgtaan

SEQ ID NO: 372763 - DNA, 1210 bp, Homo sapiens
acgccctctggcccctgcctctagccccgcctctcgcctcgccgcctcgccgccctgccaccctgccgccctgccgccctgccgccctgccgccctgccgccctgccgccctgccgccggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggaagaagttgcctatgaagaaagggcctgtgaaggcggcaaatttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatgcagtttggtggttatgccaaggaagcagactacgtagcacaagccacccgtctgcgtgctgccctggagggcacagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacggtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaacagctgagacaaa

SEQ ID NO: 372764 - DNA, 666 bp, Homo sapiens
ctatctcctccatgatcctgactacaataattaaaaaaaaaaaccacctagcagtttggtggttatgccaaggaagcagactacgtagcacaagccacccgtctgcgtgctgccctggagggcacagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacggtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaacagctgagacaaa

SEQ ID NO: 372765 - DNA, 739 bp, Homo sapiens
ccccagtcttaccactctagcatgcttgtcataataaacatggtgagtgacttttttctaaagatcccccctctctcagaggtcatgtcctttcgtaaccagcccttgctcttgaacccccaggcagtttggtggttatgccaaggaagcagactacgtagcacaagccacccgtctgcgtgctgccctggagggcacagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacggtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaacagctgagacaaa

SEQ ID NO: 372766 - DNA, 1742 bp, Homo sapiens
acgccctctggcccctgcctctagccccgcctctcgcctcgccgcctcgccgccctgccaccctgccgccctgccgccctgccgccctgccgccctgccgccctgccgccctgccgccggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggaagaagttgcctatgaagaaagggcctgtgaaggcggcaaatttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatgcagtttggtggttatgccaaggaagcagactacgtagcacaagccacccgtctgcgtgctgccctggagggcacagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacggtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaacagctgagacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaagaaagaaaaaaaaaaagaaaaaaaaaaaggaagaagacaaggagaagcacgaaaaaaacaaacaagaaaagagaaacgagacaaagaggagaagaagaaaaaaaaagacaacacagaagaaaaggcgacaaaacgacatgaaagaacacagcagcgaagagaggcccagcacaaaagcacagagcacaaagcggataaggccggaaggaagacacaacagcgggaaaaaaaaacagaagaggcacgaaaagcagggcacgagcgcgcaaaagggaagacaccccgagaagcacaatatcgcaacaaagacagaagagacgaagcggaagaaaagaaagagagaggcgaacaacacagcgagaggcaggcgacacggagagaagaaagaagagaggaggcaggagcacacggggggggt

SEQ ID NO: 372767 - DNA, 1271 bp, Homo sapiens
  misc_feature (1212)..(1213): n is a, c, g, or t
acgccctctggcccctgcctctagccccgcctctcgcctcgccgcctcgccgccctgccaccctgccgccctgccgccctgccgccctgccgccctgccgccctgccgccctgccgccggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggaagaagttgcctatgaagaaagggcctgtgaaggcggcaaatttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatgcagtttggtggttatgccaaggaagcagactacgtagcacaagccacccgtctgcgtgctgccctggagggcacagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacggtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaacagctgagacaaacnnagagaaacagaggacgaaacaataaaaaaaaaaaagtaaatggccctctttggcctca

SEQ ID NO: 372768 - DNA, 1262 bp, Homo sapiens
acgccctctggcccctgcctctagccccgcctctcgcctcgccgcctcgccgccctgccaccctgccgccctgccgccctgccgccctgccgccctgccgccctgccgccctgccgccggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggaagaagttgcctatgaagaaagggcctgtgaaggcggcaaatttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatgcagtttggtggttatgccaaggaagcagactacgtagcacaagccacccgtctgcgtgctgccctggagggcacagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacggtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaacagctgagacaaaagcgcttcgcccgaagcaatttttaaataattttatcgaacaacgactataa

SEQ ID NO: 372769 - DNA, 1080 bp, Homo sapiens
acgccctctggcccctgcctctagccccgcctctcgcctcgccgcctcgccgccctgccaccctgccgccctgccgccctgccgccctgccgccctgccgccctgccgccctgccgccggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggaagaagttgcctatgaagaaagggcctgtgaaggcggcaaatttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatgcagtttggtggttatgccaaggaagcagactacgtagcacaagccacccgtctgcgtgctgccctggagggcacagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaacagctgagacaaa

SEQ ID NO: 372770 - DNA, 1802 bp, Homo sapiens
  misc_feature (1341)..(1341): n is a, c, g, or t
  misc_feature (1461)..(1461): n is a, c, g, or t
  misc_feature (1570)..(1570): n is a, c, g, or t
  misc_feature (1628)..(1628): n is a, c, g, or t
  misc_feature (1740)..(1740): n is a, c, g, or t
  misc_feature (1747)..(1747): n is a, c, g, or t
acgccctctggcccctgcctctagccccgcctctcgcctcgccgcctcgccgccctgccaccctgccgccctgccgccctgccgccctgccgccctgccgccctgccgccctgccgccggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggaagaagttgcctatgaagaaagggcctgtgaaggcggcaaatttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatgcagtttggtggttatgccaaggaagcagactacgtagcacaagccacccgtctgcgtgctgccctggagggcacagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacggtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaacagctgagacaaaaaaaaaaaaatgggctcgttggcctcagcgcaggagcgtttggggcggtctcctttagtgagtgtcaattcatgacacttagtgaatgactgtctgagcttggaccgtcggcggcggcgagcggatgagtnttattgaggatggtatacggcgactccaggaccacggcgtacctggcgaagaatatgttgagatacagctcagcgacggcccgcacccgcccgcggcgcggtggctgcggtttcccaggntcgttcgcctgggtggctctcggtacgtccttacgctgcgccgccccgcggcagcactcaccacacagcgtttctctgcgacgtcctatcactaatcggcgccacgcgncgtatgactctgtccctgtatccttgtcccgcgccgtcgcagctcactcgagacgcangcgtgagcacgagcaaacagcccgcccgcctcgctatcacagcgttcattaatctcgtactcccgcaacacgcctctctcccgccccacacccacactcttcccctcctcanatcacantgcatgcttgccgtagcgccaacgccggcaacccgtgtgacgtccacccgcgagt

SEQ ID NO: 372771 - DNA, 1305 bp, Homo sapiens
  misc_feature (1215)..(1215): n is a, c, g, or t
acgccctctggcccctgcctctagccccgcctctcgcctcgccgcctcgccgccctgccaccctgccgccctgccgccctgccgccctgccgccctgccgccctgccgccctgccgccggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggaagaagttgcctatgaagaaagggcctgtgaaggcggcaaatttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatgcagtttggtggttatgccaaggaagcagactacgtagcacaagccacccgtctgcgtgctgccctggagggcacagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacggtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaacagctgagacaaaggccnaaggagatgggtgggcggataggaggggggggaagggggggaaagaaaaaaaaaaagttggcctctttgccctcacgggggggacttttg

SEQ ID NO: 372772 - DNA, 670 bp, Homo sapiens
aaggaagtcaaatgtgcgacagaaaaaataacaaccacaataacatttcaggccagtacagctgagttatgcctttgaagcagactacgtagcacaagccacccgtctgcgtgctgccctggagggcacagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacggtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaacagctgagacaaa

SEQ ID NO: 372773 - DNA, 1363 bp, Homo sapiens
acgccctctggcccctgcctctagccccgcctctcgcctcgccgcctcgccgccctgccaccctgccgccctgccgccctgccgccctgccgccctgccgccctgccgccctgccgccggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggaagaagttgcctatgaagaaagggcctgtgaaggcggcaaatttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatctgaaagtgccaaatgtggtgtctagcctggctccatggaatttttaacacggagttctcacacagcatatgatcattcctcaactcgccacttgatgtcactgcatagtcaaatgagcattcaaaattaccctgcagtggtttgtgttatttctgattctgttgaaagcaatgttaatgagatggtagaaggcaaatgtactacttcaaatgcaaaagtactctatcaaataatgcagtgagtgcattcaatgacaaaattaattctaaaatgaaagcctggcgtccttcattcagtcttccttctttatgaccttgtgaagagatgtttacaaagggattatacatttattagcatcgttaattaccggtgcttttagatgaatagaatgctgtgaaaaaaaatagcactatcagaatatgtttagtattcacaagaggcaatagaattatcctcacacttagaccagcagcaacattccagactactgtcctttctctatgcacttaagttagagtttggccttttcagctcatttcagcaccaggttctcaatagggaccaacagcaggagaagtttgatggtcttaatgaaactttcacggtttaaatgaaatgtctagatataaaggaaaaagttggaaaccaggagtttattttcagggtaacctatgctccaacccagttcatcattcagtggccataggacctttggtatattgccagcctcactgtacctcagtttcctcatctgtaagatgggcatga

SEQ ID NO: 372774 - DNA, 1979 bp, Homo sapiens
cccttctttttcctccctcccctccaaccgcgccccccctcccggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgatgaggggctgcgggctcgcgccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttggggagcacgaggtacccgtgcccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaagaggagataaaggcagaaaacaccacaggaaattggctgacagcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttcctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaaaccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccaaatattgtcctgtccctgtctgggagttgtgttatttaaagatattctgtatgttgtatcttttgcatgtagcttccttaatggagaaaaaaaaacctaataaatttccagaatcataatcctcaaaaaaaag

SEQ ID NO: 372775 - DNA, 1178 bp, Homo sapiens
ccctggctttcgactagcgtccgctgagctccaggctggtggcgcgtcacttagctggggaagaggagataaaggcagaaaacaccacaggaaattggctgacagcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttcctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaaaccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccaaatattgtcctgtccctgtctgggagttgtgttatttaaagatattctgtatgttgtatcttttgcatgtagcttccttaatggagaaaaaaaaacctaataaatttccagaatcataatcctcaaaaaaaag

SEQ ID NO: 372776 - DNA, 1495 bp, Homo sapiens
ctcccaggcgcgtgctggctgtggtttgctttctcaatgctggtgtcctggggagctgacgtcccccagctcaggtcaggggcttgcaaaaagcctaaaatggcgatcttgggccagggactagggaaggctggggagatggggggagttctctttactgcgttttcccagttgaaaattgtttcctgcgaaacgcgatttgttgtttgtgggtctgatttgtgcgtgcggcttgggctcctgcggcttttggctcggccgggggccttgggcagcgaggctggagccggaagaggtggaggtgaagggctgcccgccacgtccctccctcctccagatgcctggcttggatggcgttggaacagggcatttggaatgttaggagataaaggcagaaaacaccacaggaaattggctgacagcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttcctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaaaccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccaaatattgtcctgtccctgtctgggagttgtgttatttaaagatattctgtatgttgtatcttttgcatgtagcttccttaatggagaaaaaaaaacctaataaatttccagaatcataatcctcaaaaaaaag

SEQ ID NO: 372777 - DNA, 1189 bp, Homo sapiens
ctcccaggcgcgtgctggctgtggtttgctttctcaatgctggtgtcctggggagctgacgtcccccagctcagaggagataaaggcagaaaacaccacaggaaattggctgacagcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttcctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaaaccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccaaatattgtcctgtccctgtctgggagttgtgttatttaaagatattctgtatgttgtatcttttgcatgtagcttccttaatggagaaaaaaaaacctaataaatttccagaatcataatcctcaaaaaaaag

SEQ ID NO: 372778 - DNA, 2956 bp, Homo sapiens
tcaatcctctgtgcaatgattccaactccagggatcagtgtctgaagtgaagctacagattgtctggtggataaataatccaagaaggaacgggggatgttatgactttttgagagaaggctaacatgtcatccttgacagataaactttaaaaaattataataatggaaatgaagaaagaaaacaacagaagatgagaatagcaaaagagctagacatttccgacagggtctcaagagcacgctcaagtcattcacatgtttccatcaaatacagacacagatcagggaagattaaaccctactaatttctcgtcggatgcctcacaacaaggtgccttccaagaactaatggccaaaatatccacccacaacacaaataagcttagaaaatctcttcttacaatcctgacacaatggaagtttccctaaaccacccagcatctaatacaaccagcacaaagaacaacaactcggcatttttttactttgagtcctgtcaacccccttctccagctttactcctattatgcatagcctatactgtggtcttaattgtgggcctttttggaaacctctctctcatcatcatcatctttaagaagcagagaaaagctcagaatttcaccagcatactgattgccaatctctccctctctgataccttggtgtgtgtcatgtgcatccattttactatcatctacactctgatggaccactggatatttggggataccatgtgcagactcacatcctatgtgcagagtgtctcaatctctgtgtccatattctcacttgtattcactgctgtcgaaagatatcagctaattgtgaacccccgtggctggaagcccagtgtgactcatgcctactggggcatcacactgatttggctgttttcccttctgctgtctattcccttcttcctgtcctaccacctcactgatgagcccttccgcaacctctctctccccactgacctctacacccaccaggtggcctgtgtggagaactggccctccaaaaaggaccggctgctcttcaccacctccctttttctgctgcagtattttgttcctctaggcttcatcctcatctgctacttgaagattgttatctgcctccgcaggagaaatgcaaaggtagataagaagaaggaaaatgagggccggctcaatgagaacaagaggatcaacacaatgttgatttccatcgtggtgacctttggagcctgctggctgccccgaatatcttcaatgtcatctttgactggtatcatgaggtgctgatgagctgccaccacgacctggtatttgtagtttgccacttggttgctatggtttccacatgtataaaccctctcttttatggctttctcaacaaaaatttccaaaaggacctggtagtgcttattcaccactgctggtgcttcacacctcaggaaagatgtgaaaatattgccatctccactatgcacacagactccaagaggtctttaagattggctcgtataacaacaggtatatgaaaattgataatgctgaagctcttcttgaatgggagctggacaggtaatggtgggaatagggcaagatgcagaaagaagaaaccagaaccaaaaatagcaactttatacccacttttcctttaggctaagactgcctgtctcatatgtctatccaacacaccctccaacatacacgaacacacataccaccccttttctcttaagaaaataactctaataattcaaacaacctgcccgccatcatttgtggcaaagaatgagaatgagaaagcagagagagaggcaaacagcagtgatggctggggaacaatgttcacagatacttttattcaatggaatatctacaaaagttatgactaatgatatgcctagtaaaaacactgctatacctccttagcactgaagcaagtctattctcagatatgaaaactgtaactttcaatcatataactattcaattaattagccaagtcagaaaatccccccttaaaattcattaattaattaacaaactaagtttggactaaagttgaagggctggttttaacttaacatttaacgaagtgttgtaattacaattaattcccatgcttgaatcatatctccagtttatgataacagtacattttattcactaacaatgctattagaactggccacaaattctttagcatagcaattatgctagaaattgctctaacaaacttattaatggccaatgtagatacagctttcctcacaaagtggcttttaatccctaattctttatgtatattaaaaagaggtcattatgactctattactggatctcagagactttgtcagtagcatttttataattagcgccagatttttaaaaccttctcatatatcttgtggcttaaacatttttaaaagagccctcatccccacagagttgcttacacaggggaatcaactagactgttctcaaaagacactaagctactgttcaaattgctattaactgaagtcacttttattaaattgtgaccagctttaccacttcttagaacaaacctcccctatatctatcaaagttgaactgcagcttatttgtatgttaaaaatgtaactgtaggctggactcagcaacttacacctgtaatcccagccctttgggaggccaaggtggaggatcacttttgcccaggagttgaagaccagcctgagcaacacagtgagactccatctctactaaaaatacaaaaaattagccaggtgtggtcatgcatacctgcagtcccagctacttagatgagaggaaggatcacctgagcctgggagatcaagtgagtcatgatcacaccactgcactccaacctggatgaaagagtgagaccctgtctcaaaaaaaaattttaaaagtaactatattttcttttgaataaaaagtaatgtttctggaaac

SEQ ID NO: 372779 - DNA, 2979 bp, Homo sapiens
ttgatagggatagaaacacatttggctgcttctatagttaacaagatgctgttacattccttgcctcactagctctgaagactatactagcgggacaaagaaagcacctgagatgagctgagaggagggtaaaggtacacagagatcccctggatatttgttctatgtcctctcaggggctttgctaccactagagaattatccatattaagaacttgcattgatattctgggttctgtttcattttttagggtctcaagagcacgctcaagtcattcacatgtttccatcaaatacagacacagatcagggaagattaaaccctactaatttctcgtcggatgcctcacaacaaggtgccttccaagaactaatggccaaaatatccacccacaacacaaataagcttagaaaatctcttcttacaatcctgacacaatggaagtttccctaaaccacccagcatctaatacaaccagcacaaagaacaacaactcggcatttttttactttgagtcctgtcaacccccttctccagctttactcctattatgcatagcctatactgtggtcttaattgtgggcctttttggaaacctctctctcatcatcatcatctttaagaagcagagaaaagctcagaatttcaccagcatactgattgccaatctctccctctctgataccttggtgtgtgtcatgtgcatccattttactatcatctacactctgatggaccactggatatttggggataccatgtgcagactcacatcctatgtgcagagtgtctcaatctctgtgtccatattctcacttgtattcactgctgtcgaaagatatcagctaattgtgaacccccgtggctggaagcccagtgtgactcatgcctactggggcatcacactgatttggctgttttcccttctgctgtctattcccttcttcctgtcctaccacctcactgatgagcccttccgcaacctctctctccccactgacctctacacccaccaggtggcctgtgtggagaactggccctccaaaaaggaccggctgctcttcaccacctccctttttctgctgcagtattttgttcctctaggcttcatcctcatctgctacttgaagattgttatctgcctccgcaggagaaatgcaaaggtagataagaagaaggaaaatgagggccggctcaatgagaacaagaggatcaacacaatgttgatttccatcgtggtgacctttggagcctgctggctgccccgaatatcttcaatgtcatctttgactggtatcatgaggtgctgatgagctgccaccacgacctggtatttgtagtttgccacttggttgctatggtttccacatgtataaaccctctcttttatggctttctcaacaaaaatttccaaaaggacctggtagtgcttattcaccactgctggtgcttcacacctcaggaaagatgtgaaaatattgccatctccactatgcacacagactccaagaggtctttaagattggctcgtataacaacaggtatatgaaaattgataatgctgaagctcttcttgaatgggagctggacaggtaatggtgggaatagggcaagatgcagaaagaagaaaccagaaccaaaaatagcaactttatacccacttttcctttaggctaagactgcctgtctcatatgtctatccaacacaccctccaacatacacgaacacacataccaccccttttctcttaagaaaataactctaataattcaaacaacctgcccgccatcatttgtggcaaagaatgagaatgagaaagcagagagagaggcaaacagcagtgatggctggggaacaatgttcacagatacttttattcaatggaatatctacaaaagttatgactaatgatatgcctagtaaaaacactgctatacctccttagcactgaagcaagtctattctcagatatgaaaactgtaactttcaatcatataactattcaattaattagccaagtcagaaaatccccccttaaaattcattaattaattaacaaactaagtttggactaaagttgaagggctggttttaacttaacatttaacgaagtgttgtaattacaattaattcccatgcttgaatcatatctccagtttatgataacagtacattttattcactaacaatgctattagaactggccacaaattctttagcatagcaattatgctagaaattgctctaacaaacttattaatggccaatgtagatacagctttcctcacaaagtggcttttaatccctaattctttatgtatattaaaaagaggtcattatgactctattactggatctcagagactttgtcagtagcatttttataattagcgccagatttttaaaaccttctcatatatcttgtggcttaaacatttttaaaagagccctcatccccacagagttgcttacacaggggaatcaactagactgttctcaaaagacactaagctactgttcaaattgctattaactgaagtcacttttattaaattgtgaccagctttaccacttcttagaacaaacctcccctatatctatcaaagttgaactgcagcttatttgtatgttaaaaatgtaactgtaggctggactcagcaacttacacctgtaatcccagccctttgggaggccaaggtggaggatcacttttgcccaggagttgaagaccagcctgagcaacacagtgagactccatctctactaaaaatacaaaaaattagccaggtgtggtcatgcatacctgcagtcccagctacttagatgagaggaaggatcacctgagcctgggagatcaagtgagtcatgatcacaccactgcactccaacctggatgaaagagtgagaccctgtctcaaaaaaaaattttaaaagtaactatattttcttttgaataaaaagtaatgtttctggaaac

SEQ ID NO: 372780 - DNA, 2629 bp, Homo sapiens
ggcgggccttgggaaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaa

SEQ ID NO: 372781 - DNA, 1180 bp, Homo sapiens
ggcgggccttgggaaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccaggtactgaagaaggagaaaagggccgggcatggtggctcacgccggtaatcccagcactttgggaggctgaggcgggcgaatcacctgaggtcagaagtttaagaccagcctggccaacgtggtgaaaccttgtctctactaaaaatacaaaaattagcgtggagtggtggcaggcgcctgtaatcccagctcctcgggaggctgaggcaggagaatcacttgaacccaggaggcggaggttgcagtgagccgagatcatgccactgcactccagcctgggcgacaaagcgagactttgtctc

SEQ ID NO: 372782 - DNA, 530 bp, Homo sapiens
tctaactccctttcctccagatcttcaggtgaagtctgagccatcttccccctgctcttcctcctccctcagctccgagtcatcgcgtctctccacagagccatccagcgagactagtagccaaccgtggactagtagccaaccgtggactagtactagtcacggttggctagtgggtgttgagcttgaacgctttcattaatgggtggctgcttttaggcctactatgggtgttaaatttgttgtactctctctacaaggttgattcctagtgtccaaagagggtaataatgacttgttggttgatggtagatattgggctgttaattgtcagttcagtgtttaaatctgacgcaggcttatgcggaggagaatgttttcatgttacttatactaacattagttcttctatagggtgatagattggtccaattgggtgtgaggaggaatataatgagtgactctgcgctccatggctgaatgcggccgaccgtggactagtactagtccacgggtggctcacgcccata

SEQ ID NO: 372783 - DNA, 379 bp, Homo sapiens
ctcgggaggctgaggcaggagaatggggtgaacccgggaggcggagcttgcagtgagccgagatcgcccactgctattagcagcaaaaggattgtaaggattgttggtggctttgcattgcatagtgttattagaagtagatgatggtgataatgctggtagaaatagtgactattaagtgcttactgagttctaggctctaggtgatgcactgtcttttttgtatgtagggaccatccttattcccatcttacagaggcagactcaggcttgtataacagattgcaactcaagcagtccatctgcagagtctttattcttacctagatacttgatacagctgaaattcttcattgtgctcagtccttctttatccaca

SEQ ID NO: 372784 - DNA, 2718 bp, Homo sapiens
ggcgggccttgggaaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaagtaagaccagtctgtccctgggagaccaacaggaatacagcctccttggaatgattcccctttttcttgtctccttctttgtaccttagaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaa

SEQ ID NO: 372785 - DNA, 2711 bp, Homo sapiens
tctctcacagaccatccaacgagctcttcgggtaggtgaggtgctccatccgtagacagagtccttggcaccccccctgtgtctcctgggagatgaccccacacccctccgtcctcagcccaagaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaa

SEQ ID NO: 372786 - DNA, 1920 bp, Homo sapiens
ggcgggccttgggaaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaaggcctcctgaatgatgccagcccagtatgctctaacctccagcctggttctcctggtgctgctgagcacagccagagca

SEQ ID NO: 372787 - DNA, 1858 bp, Homo sapiens
tggagtccaggtgttgggctggcggattctttcaaagtcatgatttccagctcttgttcatttcccacccagcgcacagccctctgacctctgctcacttgccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaa

SEQ ID NO: 372788 - DNA, 1845 bp, Homo sapiens
tcagagttgagcgcgttacctccgctgggcaatggcatcagagctgttctccagacacagtccttctgcagtcccgtcgtcgagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaa

SEQ ID NO: 372789 - DNA, 1947 bp, Homo sapiens
tggagtccaggtgttgggctggcggattctttcaaagtcatgatttccagctcttgttcatttcccacccagcgcacagccctctgacctctgctcacttgccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaagtaagaccagtctgtccctgggagaccaacaggaatacagcctccttggaatgattcccctttttcttgtctccttctttgtaccttagaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaa

SEQ ID NO: 372790 - DNA, 694 bp, Homo sapiens
ggcgggccttgggaaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggtgagcaccaccttccttccttcctccaggttttccagtgagttcctcctgacctagaggtatgagagctttcccttcttcagc

SEQ ID NO: 372791 - DNA, 807 bp, Homo sapiens
ggcgggccttgggaaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgcctcctgaatgatgccagcccagtatgctctaacctccagcctggttctcctggtgctgctgagcacagccagagca

SEQ ID NO: 372792 - DNA, 1009 bp, Homo sapiens
  misc_feature (818)..(818): n is a, c, g, or t
ggcgggccttgggaaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaaaaaaagtggctgccttcctggctcgtgatggggagtttgggggaaagtggcttttccagagccagcatcaaagaatcaagcactgaagacatagctggctctgaggtggggtgggtgcgggatcacagaccgcatgtcatccccttgcccccaccccngcaactctggggtatatctgtgtctagcaacgatgtctcatggcgtgacagactagaggatacgcatccctggaatgtgagtcaacaggaaagatggggccccacgccttcaggcctcctgaatgatgccagcccagtatgctctaacctccagcctggttctcctggtgctgctgagcacagccagagca

SEQ ID NO: 372793 - DNA, 414 bp, Homo sapiens
tcgaactcctgagctcaggcagtctgcccacctcagcctcccaaagtgctaggattacaggcttgagccacctcgcctggcctcctgctccattatttttccagtggagagtagatgatggtgataatgctggtagaaatagtgactattaagtgcttactgagttctaggctctaggtgatgcactgtcttttttgtatgtagggaccatccttattcccatcttacagaggcagactcaggcttgtataacagattgcaactcaagcagtccatctgcagagtctttattcttacctagatacttgatacagctgaaattcttcattgtgctcagtccttctttatccacagcatcagtgagcctccttcagctcccatctctcctcggatgaacaagggggagcctcaacc

SEQ ID NO: 372794 - DNA, 466 bp, Homo sapiens
atgtagggaccatccttattcccatcttacagaggcagactcaggcttgtataacagattgcaactcaagcagtccatctgcagagtctttattcttacctagatacttgatacagctgaaattcttcattgtgctcagtccttctttatccacagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcaggtgaggagagagagagagggccccctctcgtttgaggatatgagttggtcttctccccgctttcagtgagggggacccaaagctttctcttgccgtcatcgccttctttgttgtgggagtgctgggcagt

SEQ ID NO: 372795 - DNA, 2011 bp, Homo sapiens
  misc_feature (1735)..(1735): n is a, c, g, or t
  misc_feature (1738)..(1739): n is a, c, g, or t
  misc_feature (1750)..(1750): n is a, c, g, or t
  misc_feature (1754)..(1754): n is a, c, g, or t
  misc_feature (1759)..(1759): n is a, c, g, or t
  misc_feature (1778)..(1778): n is a, c, g, or t
  misc_feature (1783)..(1783): n is a, c, g, or t
  misc_feature (1788)..(1789): n is a, c, g, or t
  misc_feature (1800)..(1800): n is a, c, g, or t
  misc_feature (1802)..(1802): n is a, c, g, or t
  misc_feature (1805)..(1805): n is a, c, g, or t
  misc_feature (1808)..(1808): n is a, c, g, or t
  misc_feature (1810)..(1810): n is a, c, g, or t
  misc_feature (1824)..(1824): n is a, c, g, or t
  misc_feature (1828)..(1829): n is a, c, g, or t
  misc_feature (1841)..(1841): n is a, c, g, or t
  misc_feature (1868)..(1869): n is a, c, g, or t
  misc_feature (1872)..(1872): n is a, c, g, or t
  misc_feature (1878)..(1878): n is a, c, g, or t
  misc_feature (1881)..(1881): n is a, c, g, or t
  misc_feature (1884)..(1884): n is a, c, g, or t
  misc_feature (1892)..(1892): n is a, c, g, or t
  misc_feature (1901)..(1901): n is a, c, g, or t
  misc_feature (1944)..(1944): n is a, c, g, or t
  misc_feature (1954)..(1954): n is a, c, g, or t
  misc_feature (1961)..(1961): n is a, c, g, or t
  misc_feature (1967)..(1967): n is a, c, g, or t
  misc_feature (1995)..(1995): n is a, c, g, or t
  misc_feature (1998)..(1998): n is a, c, g, or t
  misc_feature (2005)..(2007): n is a, c, g, or t
taattaattaattaaaaaaaaaggccaggcacagtggctcacgcctgtaatcccagcactttggcaggccaaggcaggcggatcacaaggtcaggagatcgagaccatcctgactaacacagtgaaaccccgtctctactaaaaatacaaaaaaattagccaggcgtggtggcgtgcgtctgtagttccagctgctggggaggctgaggcaggagaatggcgtgaacccgggaggcggagcttgcagtgagccgagatcgcaccactgcactccagcctggtcgacagagcaagactgcatctcaaaaaagaaaaaaaggagaaaaggaggcgggctgcattgaccctgtcagagagcttgcagccattgaggctgcccaatccttgggtgctcttgtgtgggtgtggacacaaggaccccacccagcgcacagccctctgacctctgctcacttgccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacccccactgtgtctcctgggagatgacccaacatcctcatttgaaaccgtccagatcaacgttatccccacctctgatgactcctcagatgtccagaccaagatagaacctgtctctccatgttcttccgtcaactctgaggcctccctgctctcagccgactcctccagccaggcttttataggagaggaggtcctggaagtgaagacagagtccctgtcgccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccaggtactgaagaaggagaaaagggccnggnntggtggctcangccngtaancccagcactttgggaggcngaggngggcnnatcacctgagntnagnagntnaagaccagcctggncaanntggtgaaacctngtctctactaaaaataaaaaattagcnnggngtggtngcnggngcctgtantcccagctnctcgggaggctgaggcaggagaatcacttgaacccaggaggcngaggttgcantgagccnagatcntgccactgcactccagcctgggcgacanagngagactnnntctc

SEQ ID NO: 372796 - DNA, 2979 bp, Homo sapiens
  misc_feature (2788)..(2788): n is a, c, g, or t
ggcgggccttgggaaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaaaaaaagtggctgccttcctggctcgtgatggggagtttgggggaaagtggcttttccagagccagcatcaaagaatcaagcactgaagacatagctggctctgaggtggggtgggtgcgggatcacagaccgcatgtcatccccttgcccccaccccngcaactctggggtatatctgtgtctagcaacgatgtctcatggcgtgacagactagaggatacgcatccctggaatgtgagtcaacaggaaagatggggccccacgccttcaggcctcctgaatgatgccagcccagtatgctctaacctccagcctggttctcctggtgctgctgagcacagccagagca

SEQ ID NO: 372797 - DNA, 2652 bp, Homo sapiens
ggcgggccttgggaaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagtccttagatacttctccttccagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaa

SEQ ID NO: 372798 - DNA, 1968 bp, Homo sapiens
ggcgggccttgggaaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaaggaccacctgccgcagcgatccaccagtcacgaacaagacctcacggccgcaaatgtccatgtaagccgcatggccccaatgagacctgtcaggccgggcctcgggacaccgaggagagagcgagga

SEQ ID NO: 372799 - DNA, 886 bp, Homo sapiens
ggcgggccttgggaaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgcgtctgctgaggacgtaattcctgcgagagctgcgtctgctgaggataagaccctgtaa

SEQ ID NO: 372800 - DNA, 2213 bp, Homo sapiens
taattaattaattaaaaaaaaaggccaggcacagtggctcacgcctgtaatcccagcactttggcaggccaaggcaggcggatcacaaggtcaggagatcgagaccatcctgactaacacagtgaaaccccgtctctactaaaaatacaaaaaaattagccaggcgtggtggcgtgcgtctgtagttccagctgctggggaggctgaggcaggagaatggcgtgaacccgggaggcggagcttgcagtgagccgagatcgcaccactgcactccagcctggtcgacagagcaagactgcatctcaaaaaagaaaaaaaggagaaaaggaggcgggctgcattgaccctgtcagagagcttgcagccattgaggctgcccaatccttgggtgctcttgtgtgggtgtggacacaaggaccccacccagcgcacagccctctgacctctgctcacttgccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaa

SEQ ID NO: 372801 - DNA, 1170 bp, Homo sapiens
agatgattgtgattcttccctgcttgtgccttggtgtcgtactaacgttgtagactgtaaaacacgatcgttgctctcgtctgattggcggcagatggatccggggtgagattgcttaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaa

SEQ ID NO: 372802 - DNA, 473 bp, Homo sapiens
tataaaccattcctcaaagacacaaaagtagaatgcaaaaaataaaaagacattgtttgttttaggttaagatgtctcaataccatcaagatgtcaattctctagcagggcatggtggcacacacctgtactatcatctacttgggtggctgaggcaggaggatcacttgagcccaggagttcaaggctgcagtgagctatgatggcaccactgcactccagcctgggcaacagagggagaccctttctccaaaaaaaagatgtcagttcttcataagttagtataagttcaatgtgatcccaataaaaacagcaatgaggccgggcaccatggctcacgcctgtaatcccagtgctttggaaggccgaggcaggtggatcacttgaggccaggagtttgagaccagcctggccaatatggcgaaaccctgtctctactaaaaataaaaaaataagctgggcatggtggcaca

SEQ ID NO: 372803 - DNA, 843 bp, Homo sapiens
  misc_feature (4)..(4): n is a, c, g, or t
ggcncagagtcgcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagcctcgctcgccatgggggaggtggagatctcggccctggcctacgtgaagatgtgcctgcatgctgcccggtacccacacgccgcagtcaacgggctgtttttggcgccagcgccgcggtctggagaatgcctgtgcctcaccgactgtgtgcccctcttccacagccacctggccctgtccgtcatgttggaggtcgccctcaaccaggtggatgtgtggggagcacaggccggtctggtggtggctggttactaccatgccaatgcagctgtgaacgatcagagccctgggcccctggccttgaaaattgctgggcgaattgcagaattcttccctgatgcagtacttattatgttggataatcagaaactggtgcctcagcctcgtgtgcccccggtcatcgtcctggagaaccaaggtctccgctgggtccctaaggataagaacttagtgatgtggagggactgggaagagtcacggcagatggtgggagctctactggaagatcgggcccaccagcaccttgtggactttgactgccaccttgatgacatccggcaggactggaccaaccagcggctcaacactcaaatcacccagtgggttggtcccactaatggaaatggaaatgcctgagccagggccagcggggcccggttccaataaagagacttgggctga

SEQ ID NO: 372804 - DNA, 1050 bp, Homo sapiens
  misc_feature (4)..(4): n is a, c, g, or t
ggcncagagtcgcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagcctcgctcgccatgggggaggtggagatctcggccctggcctacgtgaagatgtgcctgcatgctgcccggtacccacacgccgcagtcaacgggctgtttttggcgccagcgccgcggtctggagaatgcctgtgcctcaccgactgtgtgcccctcttccacagccacctggccctgtccgtcatgttggaggtcgccctcaaccaggtggatgtgtggggagcacaggccggtctggtggtggctggttactaccatgccaatgcagctgtgaacgatcagagccctgggcccctggccttgaaaattgctgggcgaattgcagaattcttccctgatgcagtacttattatgttggataatcagaaactggtgcctcagcctcgtgtgcccccggtcatcgtcctggagaaccaaggtctccgctgggtccctaaggataagaacttagtgatgtggagggactgggaagagtcacggcagatggtgggagctctactggaagatcgggcccaccagcaccttgtggactttgactgccaccttgatgacatccggcaggactggaccaaccagcggctcaacactcaaatcacccagtgggttggtcccactaatggaaatggaaatgcctgagccagggccagcggggcccggttccaataaagagacttgggctgaaaaaaaaaaaaaaaaaaaaaaaaaaaaaaaaaaaaaaaaaaaaaaaaaaaaaaaaaaaccaaaaaacaagcggcgcgcgcccctccactaaaaaataccccaccgcggggcgcccccacacgtcacgcccacccccgagctcttacacgacaagagggcggcccccaaaaaggagacctctaataaaacacacagcacaccggcccg

SEQ ID NO: 372805 - DNA, 964 bp, Homo sapiens
  misc_feature (4)..(4): n is a, c, g, or t
ggcncagagtcgcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagtgagagggcacggggaagggtcaaagagcgtgccgaagcgctggagggagcttcacggacgcgagctaggcaccggctcgcctaatccggtactaatccggcttgctgcttcccgtccaggcctcgctcgccatgggggaggtggagatctcggccctggcctacgtgaagatgtgcctgcatgctgcccggtacccacacgccgcagtcaacgggctgtttttggcgccagcgccgcggtctggagaatgcctgtgcctcaccgactgtgtgcccctcttccacagccacctggccctgtccgtcatgttggaggtcgccctcaaccaggtggatgtgtggggagcacaggccggtctggtggtggctggttactaccatgccaatgcagctgtgaacgatcagagccctgggcccctggccttgaaaattgctgggcgaattgcagaattcttccctgatgcagtacttattatgttggataatcagaaactggtgcctcagcctcgtgtgcccccggtcatcgtcctggagaaccaaggtctccgctgggtccctaaggataagaacttagtgatgtggagggactgggaagagtcacggcagatggtgggagctctactggaagatcgggcccaccagcaccttgtggactttgactgccaccttgatgacatccggcaggactggaccaaccagcggctcaacactcaaatcacccagtgggttggtcccactaatggaaatggaaatgcctgagccagggccagcggggcccggttccaataaagagacttgggctga

SEQ ID NO: 372806 - DNA, 1139 bp, Homo sapiens
  misc_feature (4)..(4): n is a, c, g, or t
ggcncagagtcgcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagtgagagggcacggggaagggtcaaagagcgtgccgaagcgctggagggagcttcacggacgcgagctaggcaccggctcgcctaatccggtactaatccggcttgctgcttcccgtccaggcctcgctcgccatgggggaggtggagatctcggccctggcctacgtgaagatgtgcctgcatgctgcccggtacccacacgccgcagtcaacgggctgtttttggcgccagcgccgcggtctggagaatgcctgtgcctcaccgactgtgtgcccctcttccacagccacctggccctgtccgtcatgttggaggtcgccctcaaccaggtggatgtgtggggagcacaggccggtctggtggtggctggttactaccatgccaatgcagctgtgaacgatcagagcactcaagcatcaagcagtcgtgcatcaagcatccagcaggcccgatccccgcaggccacctacagggaaaggccacagctgcgcccacacctatgagacctgggaggcccagctcaaatggatgggttttgcccacagttggctcctcactcctctgatcttccctctacacagccctgggcccctggccttgaaaattgctgggcgaattgcagaattcttccctgatgcagtacttattatgttggataatcagaaactggtgcctcagcctcgtgtgcccccggtcatcgtcctggagaaccaaggtctccgctgggtccctaaggataagaacttagtgatgtggagggactgggaagagtcacggcagatggtgggagctctactggaagatcgggcccaccagcaccttgtggactttgactgccaccttgatgacatccggcaggactggaccaaccagcggctcaacactcaaatcacccagtgggttggtcccactaatggaaatggaaatgcctgagccagggccagcggggcccggttccaataaagagacttgggctga

SEQ ID NO: 372807 - DNA, 1018 bp, Homo sapiens
  misc_feature (4)..(4): n is a, c, g, or t
ggcncagagtcgcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagcctcgctcgccatgggggaggtggagatctcggccctggcctacgtgaagatgtgcctgcatgctgcccggtacccacacgccgcagtcaacgggctgtttttggcgccagcgccgcggtctggagaatgcctgtgcctcaccgactgtgtgcccctcttccacagccacctggccctgtccgtcatgttggaggtcgccctcaaccaggtggatgtgtggggagcacaggccggtctggtggtggctggttactaccatgccaatgcagctgtgaacgatcagagcactcaagcatcaagcagtcgtgcatcaagcatccagcaggcccgatccccgcaggccacctacagggaaaggccacagctgcgcccacacctatgagacctgggaggcccagctcaaatggatgggttttgcccacagttggctcctcactcctctgatcttccctctacacagccctgggcccctggccttgaaaattgctgggcgaattgcagaattcttccctgatgcagtacttattatgttggataatcagaaactggtgcctcagcctcgtgtgcccccggtcatcgtcctggagaaccaaggtctccgctgggtccctaaggataagaacttagtgatgtggagggactgggaagagtcacggcagatggtgggagctctactggaagatcgggcccaccagcaccttgtggactttgactgccaccttgatgacatccggcaggactggaccaaccagcggctcaacactcaaatcacccagtgggttggtcccactaatggaaatggaaatgcctgagccagggccagcggggcccggttccaataaagagacttgggctga

SEQ ID NO: 372808 - DNA, 1302 bp, Homo sapiens
  misc_feature (4)..(4): n is a, c, g, or t
ggcncagagtcgcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagtgagagggcacggggaagggtcaaagagcgtgccgaagcgctggagggagcttcacggacgcgagctaggcaccggctcgcctaatccggtactaatccggcttgctgcttcccgtccaggcctcgctcgccatgggggaggtggagatctcggccctggcctacgtgaagatgtgcctgcatgctgcccggtacccacacgccgcagtcaacgggctgtttttggcgccagcgccgcggtctggagaatgcctgtgcctcaccgactgtgtgcccctcttccacagccacctggccctgtccgtcatgttggaggtcgccctcaaccaggtggatgtgtggggagcacaggccggtctggtggtggctggttactaccatgccaatgcagctgtgaacgatcagagcactcaagcatcaagcagtcgtgcatcaagcatccagcaggcccgatccccgcaggccacctacagggaaaggccacagctgcgcccacacctatgagacctgggaggcccagctcaaatggatgggttttgcccacagttggctcctcactcctctgatcttccctctacacagccctgggcccctggccttgaaaattgctgggcgaattgcagaattcttccctgatgcagtacttattatgttggataatcagaaactggtgcctcagcctcgtgtgcccccggtcatcgtcctggagaaccaaggtctccgctgggtccctaaggataagaacttgtgagtaccccactccctctacctcttcttagaagcccaaggctcctgggtctcctctgtccttggccctgccccaagggtctttctctagacccaatctctgttaagtctgtgtctggacccactacttgctgtttgacctccatgggggttactatttcagagtgatgtggagggactgggaagagtcacggcagatggtgggagctctactggaagatcgggcccaccagcaccttgtggactttgactgccaccttgatgacatccggcaggactggaccaaccagcggctcaacactcaaatcacccagtgggttggtcccactaatggaaatggaaatgcctgagccagggccagcggggcccggttccaataaagagacttgggctga

SEQ ID NO: 372809 - DNA, 818 bp, Homo sapiens
  misc_feature (4)..(4): n is a, c, g, or t
ggcncagagtcgcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagtgagagggcacggggaagggtcaaagagcgtgccgaagcgctggagggagcttcacggacgcgagctaggcaccggctcgcctaatccggtggatgtgtggggagcacaggccggtctggtggtggctggttactaccatgccaatgcagctgtgaacgatcagagcactcaagcatcaagcagtcgtgcatcaagcatccagcaggcccgatccccgcaggccacctacagggaaaggccacagctgcgcccacacctatgagacctgggaggcccagctcaaatggatgggttttgcccacagttggctcctcactcctctgatcttccctctacacagccctgggcccctggccttgaaaattgctgggcgaattgcagaattcttccctgatgcagtacttattatgttggataatcagaaactggtgcctcagcctcgtgtgcccccggtcatcgtcctggagaaccaaggtctccgctgggtccctaaggataagaacttagtgatgtggagggactgggaagagtcacggcagatggtgggagctctactggaagatcgggcccaccagcaccttgtggactttgactgcctaaatatctacatgccgatatatatatatatctatgtgtgtatatgatatctatatacac

SEQ ID NO: 372810 - DNA, 1045 bp, Homo sapiens
  misc_feature (4)..(4): n is a, c, g, or t
ggcncagagtcgcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagcctcgctcgccatgggggaggtggagatctcggccctggcctacgtgaagatgtgcctgcatgctgcccggtacccacacgccgcagtcaacgggctgtttttggcgccagcgccgcggtctggagaatgcctgtgcctcaccgactgtgtgcccctcttccacagccacctggccctgtccgtcatgttggaggtcgccctcaaccaggtggatgtgtggggagcacaggccggtctggtggtggctggttactaccatgccaatgcagctgtgaacgatcagagcaatatctgagcacctgtctcccacagcactcaagcatcaagcagtcgtgcatcaagcatccagcaggcccgatccccgcaggccacctacagggaaaggccacagctgcgcccacacctatgagacctgggaggcccagctcaaatggatgggttttgcccacagttggctcctcactcctctgatcttccctctacacagccctgggcccctggccttgaaaattgctgggcgaattgcagaattcttccctgatgcagtacttattatgttggataatcagaaactggtgcctcagcctcgtgtgcccccggtcatcgtcctggagaaccaaggtctccgctgggtccctaaggataagaacttagtgatgtggagggactgggaagagtcacggcagatggtgggagctctactggaagatcgggcccaccagcaccttgtggactttgactgccaccttgatgacatccggcaggactggaccaaccagcggctcaacactcaaatcacccagtgggttggtcccactaatggaaatggaaatgcctgagccagggccagcggggcccggttccaataaagagacttgggctga

SEQ ID NO: 372811 - DNA, 628 bp, Homo sapiens
  misc_feature (4)..(4): n is a, c, g, or t
ggcncagagtcgcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagcctcgctcgccatgggggaggtggagatctcggccctggcctacgtgaagatgtgcctgcatgctgcccggtacccacacgccgcagtcaacgggctgtttttggcgccagcgccgcggtctggagaatgcctgtgcctcaccgactgtgtgcccctcttccacagccacctggccctgtccgtcatgttggaggtcgccctcaaccaggtggatgtgtggggagcacaggccggtctggtggtggctggttactaccatgccaatgcagctgtgaacgatcagagccctgggcccctggccttgaaaattgctgggcgaattgcagaattcttccctgatgcagtacttattatgcaaccagcggctcaacactcaaatcacccagtgggttggtcccactaatggaaatggaaatgcctgagccagggccagcggggcccggttccaataaagagacttgggctga

SEQ ID NO: 372812 - DNA, 2331 bp, Homo sapiens
  misc_feature (186)..(186): n is a, c, g, or t
  misc_feature (542)..(542): n is a, c, g, or t
  misc_feature (544)..(544): n is a, c, g, or t
tcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcnccccgagaaacaaccggcacccggggacgcctacgggatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagtgcacccacctccttctccaatcagatgtagtctggtcagtgaagcccaggaggacctggggggggcaagagctcaggagaaggcctgccccccttcccacccctataccctaggtctccacccctcaagccaggagaccctgtctttgctgtttatatataanancatggacgtggtgaatcagctggtggctgggggtcagttccgggtggtcaaggagcccctcggctttgtgaaggtgctgcaatgggtcttcgccatcttcgcctttgccacatgcggcagctacagtggggagctccagctgagcgtggattgtgccaacaagaccgagagtgacctcagcatcgaggtcgagttcgagtaccccttcaggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccgagagaataacaaagggcccatgctggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtgagtgaccggcgagcggtgcggccaaggagggtacaaggaaggagacgagcgggtcagtgaaccaataagagtcaggggtagagagtacgtaaggcgtttactggggcaagtaaggactgaagtttgaaggagccaatcaagaggcagaactacctgctaagagctgaaaaactagctaatgaatggagaaaagaagaatggtgcttcaagatggacagaatgaagagccaatgggagggaggtagaagggcaactcggcggaaaggcagggggagagaagcagagcaaccaataaagggagggaatatcgggggacttgcgcagtggcgaatcagcggagcgcaagagccacggaagcgacgaggaggtgggtcttagaagtgactgataagccaataggtgataaggccaatagatggtgagggtaaatgggcgtggatcttgaaggtcagacgagctcaccaatccgggaggaggggatagatctgccgcctctccccaacgctggaggggagggaagtagtgtggaatttcaaaggaggaagagggatagggtggggttctggaaaggtttgccggccttcttgctgggccttaaaagagaagtgagggtcggggcttggtggctcatgcctgtaatctcagcactttgggagaccgaggcgggcgggccgcttgagcccaagagttcgagaccagcctgggcaacatgatgaaatcccacctctacaaaaaatacaaaaattagccgggcgtggtggcatgcatctgtggacccatctactcaggaggctgaagtgggaggatcacttaagcccaggaggttgaggctgccgtgagctatgatcctgccac

SEQ ID NO: 372813 - DNA, 2253 bp, Homo sapiens
acatccactgggatcactgagcacctgccttgtacctggcactgctctggactctaggactatgtggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccgagagaataacaaagggcccatgctggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtcagtgaagcccaggaggacctggggggggcaagagctcaggagaaggcctgccccccttcccacccctataccctaggtctccacccctcaagccaggagaccctgtctttgctgtttatatatatatatattatatataaatatctatttatctgtctgagccctgccctcactccactcccctcatccactaggtgcccagtcttgagtgggccccctctcttaccccgtccctttccctgcatcccttggcccctctctgtttaccctccctgtcccctgaggttaaggggatctaaaaggaggacagggagggaacagacctcggctgtgtggggagggtgggcgtgacttcagactctctcctctctctccctccactcctcccaactctggccttggttcctccagcaatgcctgcctgaacaaaggccgttagggaaatccaactccagggttaaagaaaggcagagattgggggggcttggggtagagaggacagtttaggacccaaggtggtcttggagaggaggtgtggagtggaggggtcagcaggggggttgggttccagacagagtggatctggagtctgaaggagaggagtgcgctagagcattctggggtggggcttggaagggcgctgagggcagggttctagaaggggcgaggctttaagcgaggcagaatggtgggctccagagtaggtgggtcttggattggtaccagagcctatggaaagggtgtggcttggaacatttgggagactgagcttgattctaaaggggacagatcttgagcaaggcaagaagtgggattcaggaatgggccaagccagggttccagacagggtggggcttagaatggggcttccatggtggtttcagaaagggcagcccctccccatggtgcagtgaagaaaatgttttacaatggctgggtttgggcagtggagaggggacttggataggagcttccagatgggttttgttaggggtgggggagaatggctctggctacgacttgggacggaagtggcctgagaagagtcgagtgatatggcttgtagggtgaggcgtgggatccagagagaagcaccccaccacacacacccttccccactcccgtgatgaaacagctaggttaataggaggacagaaccaacgggtctgtgggactggcccacccctcttcccccttcccctgcgccctccctccctccacacctccacccgtcctggggtggttggaggcctggtctggagcccctatcctgcaccctctgctatgtctgtgatgtcagtagtgcctgtgatcgtgtgttgccattttgtctggctgtggcccctccttctcccctccagacccctaccctttcccaaacccttcggtattgttcaaagaacccccctccccaaggaagaacaaatatgattctcctctcccaaataaactccttaaccaccta

SEQ ID NO: 372814 - DNA, 2080 bp, Homo sapiens
cggacatggacgtggtgaatcagctggtggctgggggtcagttccgggtggtcaaggagcccctcggctttgtgaaggtgctgcaatgggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtcagtgaagcccaggaggacctggggggggcaagagctcaggagaaggcctgccccccttcccacccctataccctaggtctccacccctcaagccaggagaccctgtctttgctgtttatatatatatatattatatataaatatctatttatctgtctgagccctgccctcactccactcccctcatccactaggtgcccagtcttgagtgggccccctctcttaccccgtccctttccctgcatcccttggcccctctctgtttaccctccctgtcccctgaggttaaggggatctaaaaggaggacagggagggaacagacctcggctgtgtggggagggtgggcgtgacttcagactctctcctctctctccctccactcctcccaactctggccttggttcctccagcaatgcctgcctgaacaaaggccgttagggaaatccaactccagggttaaagaaaggcagagattgggggggcttggggtagagaggacagtttaggacccaaggtggtcttggagaggaggtgtggagtggaggggtcagcaggggggttgggttccagacagagtggatctggagtctgaaggagaggagtgcgctagagcattctggggtggggcttggaagggcgctgagggcagggttctagaaggggcgaggctttaagcgaggcagaatggtgggctccagagtaggtgggtcttggattggtaccagagcctatggaaagggtgtggcttggaacatttgggagactgagcttgattctaaaggggacagatcttgagcaaggcaagaagtgggattcaggaatgggccaagccagggttccagacagggtggggcttagaatggggcttccatggtggtttcagaaagggcagcccctccccatggtgcagtgaagaaaatgttttacaatggctgggtttgggcagtggagaggggacttggataggagcttccagatgggttttgttaggggtgggggagaatggctctggctacgacttgggacggaagtggcctgagaagagtcgagtgatatggcttgtagggtgaggcgtgggatccagagagaagcaccccaccacacacacccttccccactcccgtgatgaaacagctaggttaataggaggacagaaccaacgggtctgtgggactggcccacccctcttcccccttcccctgcgccctccctccctccacacctccacccgtcctggggtggttggaggcctggtctggagcccctatcctgcaccctctgctatgtctgtgatgtcagtagtgcctgtgatcgtgtgttgccattttgtctggctgtggcccctccttctcccctccagacccctaccctttcccaaacccttcggtattgttcaaagaacccccctccccaaggaagaacaaatatgattctcctctcccaaataaactccttaaccaccta

SEQ ID NO: 372815 - DNA, 2693 bp, Homo sapiens
  misc_feature (186)..(186): n is a, c, g, or t
  misc_feature (542)..(542): n is a, c, g, or t
  misc_feature (544)..(544): n is a, c, g, or t
tcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcnccccgagaaacaaccggcacccggggacgcctacgggatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagtgcacccacctccttctccaatcagatgtagtctggtcagtgaagcccaggaggacctggggggggcaagagctcaggagaaggcctgccccccttcccacccctataccctaggtctccacccctcaagccaggagaccctgtctttgctgtttatatataanancatggacgtggtgaatcagctggtggctgggggtcagttccgggtggtcaaggagcccctcggctttgtgaaggtgctgcaatgggtcttcgccatcttcgcctttgccacatgcggcagctacagtggggagctccagctgagcgtggattgtgccaacaagaccgagagtgacctcagcatcgaggtcgagttcgagtaccccttcaggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccgagagaataacaaagggcccatgctggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtcagtgaagcccaggaggacctggggggggcaagagctcaggagaaggcctgccccccttcccacccctataccctaggtctccacccctcaagccaggagaccctgtctttgctgtttatatatatatatattatatataaatatctatttatctgtctgagccctgccctcactccactcccctcatccactaggtgcccagtcttgagtgggccccctctcttaccccgtccctttccctgcatcccttggcccctctctgtttaccctccctgtcccctgaggttaaggggatctaaaaggaggacagggagggaacagacctcggctgtgtggggagggtgggcgtgacttcagactctctcctctctctccctccactcctcccaactctggccttggttcctccagcaatgcctgcctgaacaaaggccgttagggaaatccaactccagggttaaagaaaggcagagattgggggggcttggggtagagaggacagtttaggacccaaggtggtcttggagaggaggtgtggagtggaggggtcagcaggggggttgggttccagacagagtggatctggagtctgaaggagaggagtgcgctagagcattctggggtggggcttggaagggcgctgagggcagggttctagaaggggcgaggctttaagcgaggcagaatggtgggctccagagtaggtgggtcttggattggtaccagagcctatggaaagggtgtggcttggaacatttgggagactgagcttgattctaaaggggacagatcttgagcaaggcaagaagtgggattcaggaatgggccaagccagggttccagacagggtggggcttagaatggggcttccatggtggtttcagaaagggcagcccctccccatggtgcagtgaagaaaatgttttacaatggctgggtttgggcagtggagaggggacttggataggagcacacctccacccgtcctggggtggttggaggcctggtctggagcccctatcctgcaccctctgctatgtctgtgatgtcagtagtgcctgtgatcgtgtgttgccattttgtctggctgtggcccctccttctcccctccagacccctaccctttcccaaacccttcggtattgttcaaagaacccccctccccaaggaagaacaaatatgattctcctctcccaaataaactccttaaccaccta

SEQ ID NO: 372816 - DNA, 441 bp, Homo sapiens
ggagagacaggcctcttctgggggacctgtgatccgaggaggccccagggcctagcgtgaagcagtccactcacagtgctgtcttcctcacccctgcctgccttaggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtaagccctgggtgctggctggaggagggagagtggaaaacagtacagtccggcatggggagtggtggagtgggagaataagaggagagtcaggggagatccaaggggtgtccctgaagaacgcgtgccaacaacaacgttga

SEQ ID NO: 372817 - DNA, 2941 bp, Homo sapiens
  misc_feature (186)..(186): n is a, c, g, or t
  misc_feature (542)..(542): n is a, c, g, or t
  misc_feature (544)..(544): n is a, c, g, or t
tcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcnccccgagaaacaaccggcacccggggacgcctacgggatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagtgcacccacctccttctccaatcagatgtagtctggtcagtgaagcccaggaggacctggggggggcaagagctcaggagaaggcctgccccccttcccacccctataccctaggtctccacccctcaagccaggagaccctgtctttgctgtttatatataanancatggacgtggtgaatcagctggtggctgggggtcagttccgggtggtcaaggagcccctcggctttgtgaaggtgctgcaatgggtcttcgccatcttcgcctttgccacatgcggcagctacagtggggagctccagctgagcgtggattgtgccaacaagaccgagagtgacctcagcatcgaggtcgagttcgagtaccccttcaggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccgagagaataacaaagggcccatgctggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtcagtgaagcccaggaggacctggggggggcaagagctcaggagaaggcctgccccccttcccacccctataccctaggtctccacccctcaagccaggagaccctgtctttgctgtttatatatatatatattatatataaatatctatttatctgtctgagccctgccctcactccactcccctcatccactaggtgcccagtcttgagtgggccccctctcttaccccgtccctttccctgcatcccttggcccctctctgtttaccctccctgtcccctgaggttaaggggatctaaaaggaggacagggagggaacagacctcggctgtgtggggagggtgggcgtgacttcagactctctcctctctctccctccactcctcccaactctggccttggttcctccagcaatgcctgcctgaacaaaggccgttagggaaatccaactccagggttaaagaaaggcagagattgggggggcttggggtagagaggacagtttaggacccaaggtggtcttggagaggaggtgtggagtggaggggtcagcaggggggttgggttccagacagagtggatctggagtctgaaggagaggagtgcgctagagcattctggggtggggcttggaagggcgctgagggcagggttctagaaggggcgaggctttaagcgaggcagaatggtgggctccagagtaggtgggtcttggattggtaccagagcctatggaaagggtgtggcttggaacatttgggagactgagcttgattctaaaggggacagatcttgagcaaggcaagaagtgggattcaggaatgggccaagccagggttccagacagggtggggcttagaatggggcttccatggtggtttcagaaagggcagcccctccccatggtgcagtgaagaaaatgttttacaatggctgggtttgggcagtggagaggggacttggataggagcttccagatgggttttgttaggggtgggggagaatggctctggctacgacttgggacggaagtggcctgagaagagtcgagtgatatggcttgtagggtgaggcgtgggatccagagagaagcaccccaccacacacacccttccccactcccgtgatgaaacagctaggttaataggaggacagaaccaacgggtctgtgggactggcccacccctcttcccccttcccctgcgccctccctccctccacacctccacccgtcctggggtggttggaggcctggtctggagcccctatcctgcaccctctgctatgtctgtgatgtcagtagtgcctgtgatcgtgtgttgccattttgtctggctgtggcccctccttctcccctccagacccctaccctttcccaaacccttcggtattgttcaaagaacccccctccccaaggaagaacaaatatgattctcctctcccaaataaactccttaaccaccta

SEQ ID NO: 372818 - DNA, 2242 bp, Homo sapiens
gagggttgagggtgttctgaggggctgggccacacctgcccacctctgtttgcaggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccgagagaataacaaagggcccatgctggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtcagtgaagcccaggaggacctggggggggcaagagctcaggagaaggcctgccccccttcccacccctataccctaggtctccacccctcaagccaggagaccctgtctttgctgtttatatatatatatattatatataaatatctatttatctgtctgagccctgccctcactccactcccctcatccactaggtgcccagtcttgagtgggccccctctcttaccccgtccctttccctgcatcccttggcccctctctgtttaccctccctgtcccctgaggttaaggggatctaaaaggaggacagggagggaacagacctcggctgtgtggggagggtgggcgtgacttcagactctctcctctctctccctccactcctcccaactctggccttggttcctccagcaatgcctgcctgaacaaaggccgttagggaaatccaactccagggttaaagaaaggcagagattgggggggcttggggtagagaggacagtttaggacccaaggtggtcttggagaggaggtgtggagtggaggggtcagcaggggggttgggttccagacagagtggatctggagtctgaaggagaggagtgcgctagagcattctggggtggggcttggaagggcgctgagggcagggttctagaaggggcgaggctttaagcgaggcagaatggtgggctccagagtaggtgggtcttggattggtaccagagcctatggaaagggtgtggcttggaacatttgggagactgagcttgattctaaaggggacagatcttgagcaaggcaagaagtgggattcaggaatgggccaagccagggttccagacagggtggggcttagaatggggcttccatggtggtttcagaaagggcagcccctccccatggtgcagtgaagaaaatgttttacaatggctgggtttgggcagtggagaggggacttggataggagcttccagatgggttttgttaggggtgggggagaatggctctggctacgacttgggacggaagtggcctgagaagagtcgagtgatatggcttgtagggtgaggcgtgggatccagagagaagcaccccaccacacacacccttccccactcccgtgatgaaacagctaggttaataggaggacagaaccaacgggtctgtgggactggcccacccctcttcccccttcccctgcgccctccctccctccacacctccacccgtcctggggtggttggaggcctggtctggagcccctatcctgcaccctctgctatgtctgtgatgtcagtagtgcctgtgatcgtgtgttgccattttgtctggctgtggcccctccttctcccctccagacccctaccctttcccaaacccttcggtattgttcaaagaacccccctccccaaggaagaacaaatatgattctcctctcccaaataaactccttaaccaccta

SEQ ID NO: 372819 - DNA, 1940 bp, Homo sapiens
  misc_feature (186)..(186): n is a, c, g, or t
  misc_feature (542)..(542): n is a, c, g, or t
  misc_feature (544)..(544): n is a, c, g, or t
tcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcnccccgagaaacaaccggcacccggggacgcctacgggatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagtgcacccacctccttctccaatcagatgtagtctggtcagtgaagcccaggaggacctggggggggcaagagctcaggagaaggcctgccccccttcccacccctataccctaggtctccacccctcaagccaggagaccctgtctttgctgtttatatataanancatggacgtggtgaatcagctggtggctgggggtcagttccgggtggtcaaggagcccctcggctttgtgaaggtgctgcaatgggtcttcgccatcttcgcctttgccacatgcggcagctacagtggggagctccagctgagcgtggattgtgccaacaagaccgagagtgacctcagcatcgaggtcgagttcgagtaccccttcaggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccgagagaataacaaagggcccatgctggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtcagtgaagcccaggaggacctggggggggcaagagctcaggagaaggcctgccccccttcccacccctataccctaggtctccacccctcaagccaggagaccctgtctttgctgtttatatatatatatattatatataaatatctatttatctgtctgagccctgccctcactccactcccctcatccactaggtgcccagtcttgagtgggcccccacacctccacccgtcctggggtggttggaggcctggtctggagcccctatcctgcaccctctgctatgtctgtgatgtcagtagtgcctgtgatcgtgtgttgccattttgtctggctgtggcccctccttctcccctccagacccctaccctttcccaaacccttcggtattgttcaaagaacccccctccccaaggaagaacaaatatgattctcctctcccaaataaactccttaaccaccta

SEQ ID NO: 372820 - DNA, 1081 bp, Homo sapiens
tctttattccctctagcacccgaaaataaagaaaaatgcgcgttatagcgccatatgtgttcgaaaagatttgatatgaaaatactctccccccgcccacccccattggttttaatgctgagaagaagaactagactcttacagaggtgagaatgaagtccacacagcaaaaatgcatctgagaattggagagcagtaaaagactgaagataatgtttgaacagccacatacaccatgcctgaagctaaaaatatatacgggtttttgaattgcagcagccaataaattccatttttgtttggttggttttggctttggcacacctgaattaggttttcttgccttggaacagaattttgacttaaacagtgttgtcattgtagcagttgtttgaagttttcagggataacatacctgatggagaaatgttttgtgtgtatgatatatgggaaagtctttagttatagtcatggcagctcctcaaccccatgattgtgatgagattgggaagcccactgtaacactggagagcccaggttatatcagacaccactagtagatagaagttctaacaacttgagctctgtaacaaaaatctcattgtactacaaaattatgtctgcaccagtgaatccattctcaagaaaagtcttaactaggaaactaaaagctttcactcttaaagctttcattttctgtttattcagttttttatttggaatggatgctactctaggccttaaactgagaaatgccaggctattgtagctattatatcttggtatttgccattttaattcctaggacagcacgcccgctttgcccttgacctggctagggagccaaggaaatgccatggttcttggtcataagacacactgcagagatctctcagtaggaaaacagggctggcccttttctttggtgatgaacacaaactgcaccctttttttctcccacgtgtccttccgctgccagccagtgttggaatctccctacccaattccagacttaattgcttactgcgtctagcacctgggtggcttcaccacctcttccttacttgtcagcagatgaatg

SEQ ID NO: 372821 - DNA, 4478 bp, Homo sapiens
acgcacttccggcctcctaaccgttctcgcgtagcggtgcgcttctggcctgttttgagtccgcgctcaaaggtgccaaagtgcaaggacccacagttgggcggagcttgggttgggagtgagacagcatagcagtccaggctggtcctttgagcgcagctcaaagaaggggacggggagggcgtcactatacaattgtggccgggtgggacctgggctgtttgctcttggaggctgtacagctgcaagctttgccgctcacgaactggagctggagaaagagccccccaaggatgggaggatgacagaagtgtctgcagatggcactgcctgggcaccaggagaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgagcctttgcctgctaagagggagaccaggtcatggcagccatgcctctgaaagctcaataccaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagttattctctagctgaggatgatgatgttgaacaagatagatacagtgtctgttccctgcagccaccagagaagacagacatataaataaactatcaccattaagggtaacagtcaccgtgggccagacccgagctagccgacagggatgcggccacagctggccgggcgtgaccacaccgaggcgcagcgaccttgttcctagagaggcccggccgcctggtgacgcacttccggcagcgccggggagcagtccgctacggaggtgagtgcagggctccgggcgctgtgtgccgtgccctgtcccccaggctctgggtccggttgagacgcactcccaccctgggtgctgcagggtctcccgtggcctacgctgccaggaggcccaggctgggagagggagcagggcggcggcccggggtgctcttccgcgctcctcgactccagctttggtctttgtggctcaatagcttgcgcccattggaaggggaaacgcacgttgctgtcccagccacgaggccctgagcatttagcacttggtcgacgggggaagatgtgtcggtgcagctaaaagatggaatatttgcgggcgtgaagcggcccgaggtgataccacaagtcttttgacatgctgaggtctggcaggaacattaacctatgtgcatcccgagtatggaccgtgtgctcccaggctcctgacatagggtcatgaattagggccgagtgggagcgcagagcccctcccagtcacccggcagcagaagcagcccggcttttggaggacattgtctcctggagcagtgtcagtcccaaaagctccagcccttctctgagacggggaccaggggatggcagccatgcacctgacagcctggccccagggacttcacggatcccctgaagctcatccatggacttccatggactacagggcctgagctatggaattggccctagggcagcaggaacctattgtttcagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgtgatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaaaaaggtatgagtacatttttaattttcatgtaattgagaaaacctttctaagtattagatgaaagctagaaactatccacagggtatgtactgataaattgactactcaaaaactaaatattcctgtatgtttttgttttaaagtttaaaagataaagcgcaaaatgggg

SEQ ID NO: 372822 - DNA, 4138 bp, Homo sapiens
aggatccttaattaaattaatccctttctcccggcacttccgttcacgcaccggtttctgtttttcctgagcctttgcctgctaagagggagaccaggtcatggcagccatgcctctgaaagctcaataccaggactttccctcaagtccctacctgtcccctctgccccacactctggcccggagccagaggattggctctggggcagcaggaacctgttgttttaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagttattctctagctgaggatgatgatgttgaacaagatagatacagtgtctgttccctgcagccaccagagaagacagacatataaataaactatcaccattaagggtaacagtcaccgtgggccagacccgagctagccgacagggatgcggccacagctggccgggcgtgaccacaccgaggcgcagcgaccttgttcctagagaggcccggccgcctggtgacgcacttccggcagcgccggggagcagtccgctacggaggtgagtgcagggctccgggcgctgtgtgccgtgccctgtcccccaggctctgggtccggttgagacgcactcccaccctgggtgctgcagggtctcccgtggcctacgctgccaggaggcccaggctgggagagggagcagggcggcggcccggggtgctcttccgcgctcctcgactccagctttggtctttgtggctcaatagcttgcgcccattggaaggggaaacgcacgttgctgtcccagccacgaggccctgagcatttagcacttggtcgacgggggaagatgtgtcggtgcagctaaaagatggaatatttgcgggcgtgaagcggcccgaggtgataccacaagtcttttgacatgctgaggtctggcaggaacattaacctatgtgcatcccgagtatggaccgtgtgctcccaggctcctgacatagggtcatgaattagggccgagtgggagcgcagagcccctcccagtcacccggcagcagaagcagcccggcttttggaggacattgtctcctggagcagtgtcagtcccaaaagctccagcccttctctgagacggggaccaggggatggcagccatgcacctgacagcctggccccagggacttcacggatcccctgaagctcatccatggacttccatggactacagggcctgagctatggaattggccctagggcagcaggaacctattgtttcagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgtgatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaaaaaggtatgagtacatttttaattttcatgtaattgagaaaacctttctaagtattagatgaaagctagaaactatccacagggtatgtactgataaattgactactcaaaaactaaatattcctgtatgtttttgttttaaagtttaaaagataaagcgcaaaatgggg

SEQ ID NO: 372823 - DNA, 3999 bp, Homo sapiens
acgcacttccggcctcctaaccgttctcgcgtagcggtgcgcttctggcctgttttgagtccgcgctcaaaggtgccaaagtgcaaggacccacagttgggcggagcttgggttgggagtgagacagcatagcagtccaggctggtcctttgagcgcagctcaaagaaggggacggggagggcgtcactatacaattgtggccgggtgggacctgggctgtttgctcttggaggctgtacagctgcaagctttgccgctcacgaactggagctggagaaagagccccccaaggatgggaggatgacagaagtgtctgcagatggcactgcctgggcaccaggagaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgagcctttgcctgctaagagggagaccaggtcatggcagccatgcctctgaaagctcaataccaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagttattctctagctgaggatgatgatgttgaacaagatagatacagtgtctgttccctgcagccaccagagaagacagacatataaataaactatcaccattaagggtaacagtcaccgtgggccagacccgagctagccgacagggatgcggccacagctggccgggcgtgaccacaccgaggcgcagcgaccttgttcctagagaggcccggccgcctggtgacgcacttccggcagcgccggggagcagtccgctacggagctccagcccttctctgagacggggaccaggggatggcagccatgcacctgacagcctggccccagggacttcacggatcccctgaagctcatccatggacttccatggactacagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgatggagtctcgctctgtcgcccaaactggagtgcagtggcaagaacttggctcaccgcaacttccgtttcccgggttcgagcaattctcctgcctcatcctcccgagtagctggaactacagtgatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaaaaaggtatgagtacatttttaattttcatgtaattgagaaaacctttctaagtattagatgaaagctagaaactatccacagggtatgtactgataaattgactactcaaaaactaaatattcctgtatgtttttgttttaaagtttaaaagataaagcgcaaaatgggg

SEQ ID NO: 372824 - DNA, 2741 bp, Homo sapiens
tccaaggtctctttagtccttcctaagccccacagtactttcccgtagtcctgaggcttgggacctcctggggttcttaccttccctccccattgctgagacagtctgagaagaggcttaggaatttgtctgtgggagtttattcatctgtctctcctatttacctctcccaaaccaggatttccacttctcaaacctgctgtgatctcacaactggagggaggaagtgagctggggggctcatctccactggctgcaggaacaggcctccagggcctccagactgtgatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaaaaaggtatgagtacatttttaattttcatgtaattgagaaaacctttctaagtattagatgaaagctagaaactatccacagggtatgtactgataaattgactactcaaaaactaaatattcctgtatgtttttgttttaaagtttaaaagataaagcgcaaaatgggg

SEQ ID NO: 372825 - DNA, 3095 bp, Homo sapiens
acgcacttccggcctcctaaccgttctcgcgtagcggtgcgcttctggcctgttttgagtccgcgctcaaaggtgccaaagtgcaaggacccacagttgggcggagcttgggttgggagtgagacagcatagcagtccaggctggtcctttgagcgcagctcaaagaaggggacggggagggcgtcactatacaattgtggccgggtgggacctgggctgtttgctcttggaggctgtacagctgcaagctttgccgctcacgaactggagctggagaaagagccccccaaggatgggaggatgacagaagtgtctgcagatggcactgcctgggcaccaggagaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgagcctttgcctgctaagagggagaccaggtcatggcagccatgcctctgaaagctcaataccaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagatgttgagaccaacattgacagtgagtccacattaatccagggaatttctgaagaaagagatgggatgatgtcacatggtcagctgaagagtgtccctcagagaactgacttcccagaaacacgtaatgtggaaaagcaccaggacatccccacagtgaaaaatatccaaggaaaggttccaagaatcccctgtgcaaggaaacctttcatatgtgaggagtgtgggaaatccttcagctacttttcttactatgctagacaccagagaatccacactggggagaaaccttttgagtgtagtgagtgtggaaaagcctttaatggtaattcttcgttaattcggcaccagaggattcacactggagagagaccctatcagtgtgaggagtgtgggcgagcctttaatgataatgcaaatctgatcaggcatcagagaatccacagtgggggacagaccctattactgtacagagtgtgggaatagtttcaccagtagttccgagtttgttatacatcagagaatccacactggggagaaaccgtatgagtgtaatgagtgtggcaaagcttttgttggtaattcacccctacttcggcatcagaaaatccacactggagagaaaccctatgagtgtaatgagtgtggcaaaagctttggaaggacttcccatctaagccaacatcagcgtattcacacaggggaaaagccttattcttgtaaagtatgtggacaagccttcaattttcatacaaaactaactcggcaccagagaattcacagtgaggagaaaccctttgactgtgtagattgtggaaaagccttcagtgctcaggaacaattaaaaaggcatctgagaattcatactcaggagtcttcctatgtatgtgatgagtgtggaaaagccttgactagcaaaagaaatcttcatcagcatcaaagaatccatactggagagaaaccctatgagtgtagcaagtatgagaaggcctttgggacttcttcccagctaggtcaccttgagcatgtctactctggagagaagcctgtgctggacatttgtcgttttggcctcccagaattttttacccccttttactggtaatagtacactccagtgaaatgtactgagtggattccgtcttctactcaggaatggaatgtgtgacacaggcctgactcagcctctgatccatccctcaagccacagttaatgattcagatgtcagtagatgaccaaagatggttcaattagagtcccaggattgcaagagctaataggaacaaatactctccccccgcccacccccattggttttaatgctgagaagaagaactagactcttacagaggtgagaatgaagtccacacagcaaaaatgcatctgagaattggagagcagtaaaagactgaagataatgtttgaacagccacatacaccatgcctgaagctaaaaatatatacgggtttttgaattgcagcagccaataaattccatttttgtttggttggttttggctttggcacacctgaattaggttttcttgccttggaacagaattttgacttaaacagtgttgtcattgtagcagttgtttgaagttttcagggataacatacctgatggagaaatgttttgtgtgtatgatatatgggaaagtctttagttatagtcatggcagctcctcaaccccatgattgtgatgagattgggaagcccactgtaacactggagagcccaggttatatcagacaccactagtagatagaagttctaacaacttgagctctgtaacaaaaatctcattgtactacaaaattatgtctgcaccagtgaatccattctcaagaaaagtcttaactaggaaactaaaagctttcactcttaaagctttcattttctgtttattcagttttttatttggaatggatgctactctaggccttaaactgagaaatgccaggctattgtagctattatatcttggtatttgccattttaattcctaggacagcacgcccgctttgcccttgacctggctagggagccaaggaaatgccatggttcttggtcataagacacactgcagagatctctcagtaggaaaacagggctggcccttttctttggtgatgaacacaaactgcaccctttttttctcccacgtgtccttccgctgccagccagtgttggaatctccctacccaattccagacttaattgcttactgcgtctagcacctgggtggcttcaccacctcttccttacttgtcagcagatgaatg

SEQ ID NO: 372826 - DNA, 2821 bp, Homo sapiens
acgcacttccggcctcctaaccgttctcgcgtagcggtgcgcttctggcctgttttgagtccgcgctcaaaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgagcctttgcctgctaagagggagaccaggtcatggcagccatgcctctgaaagctcaataccaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagatgttgagaccaacattgacagtgagtccacattaatccagggaatttctgaagaaagagatgggatgatgtcacatggtcagctgaagagtgtccctcagagaactgacttcccagaaacacgtaatgtggaaaagcaccaggacatccccacagtgaaaaatatccaaggaaaggttccaagaatcccctgtgcaaggaaacctttcatatgtgaggagtgtgggaaatccttcagctacttttcttactatgctagacaccagagaatccacactggggagaaaccttttgagtgtagtgagtgtggaaaagcctttaatggtaattcttcgttaattcggcaccagaggattcacactggagagagaccctatcagtgtgaggagtgtgggcgagcctttaatgataatgcaaatctgatcaggcatcagagaatccacagtgggggacagaccctattactgtacagagtgtgggaatagtttcaccagtagttccgagtttgttatacatcagagaatccacactggggagaaaccgtatgagtgtaatgagtgtggcaaagcttttgttggtaattcacccctacttcggcatcagaaaatccacactggagagaaaccctatgagtgtaatgagtgtggcaaaagctttggaaggacttcccatctaagccaacatcagcgtattcacacaggggaaaagccttattcttgtaaagtatgtggacaagccttcaattttcatacaaaactaactcggcaccagagaattcacagtgaggagaaaccctttgactgtgtagattgtggaaaagccttcagtgctcaggaacaattaaaaaggcatctgagaattcatactcaggagtcttcctatgtatgtgatgagtgtggaaaagccttgactagcaaaagaaatcttcatcagcatcaaagaatccatactggagagaaaccctatgagtgtagcaagtatgagaaggcctttgggacttcttcccagctaggtcaccttgagcatgtctactctggagagaagcctgtgctggacatttgtcgttttggcctcccagaattttttacccccttttactggtaatagtacactccagtgaaatgtactgagtggattccgtcttctactcaggaatggaatgtgtgacacaggcctgactcagcctctgatccatccctcaagccacagttaatgattcagatgtcagtagatgaccaaagatggttcaattagagtcccaggattgcaagagctaataggaacaaatactctccccccgcccacccccattggttttaatgctgagaagaagaactagactcttacagaggtgagaatgaagtccacacagcaaaaatgcatctgagaattggagagcagtaaaagactgaagataatgtttgaacagccacatacaccatgcctgaagctaaaaatatatacgggtttttgaattgcagcagccaataaattccatttttgtttggttggttttggctttggcacacctgaattaggttttcttgccttggaacagaattttgacttaaacagtgttgtcattgtagcagttgtttgaagttttcagggataacatacctgatggagaaatgttttgtgtgtatgatatatgggaaagtctttagttatagtcatggcagctcctcaaccccatgattgtgatgagattgggaagcccactgtaacactggagagcccaggttatatcagacaccactagtagatagaagttctaacaacttgagctctgtaacaaaaatctcattgtactacaaaattatgtctgcaccagtgaatccattctcaagaaaagtcttaactaggaaactaaaagctttcactcttaaagctttcattttctgtttattcagttttttatttggaatggatgctactctaggccttaaactgagaaatgccaggctattgtagctattatatcttggtatttgccattttaattcctaggacagcacgcccgctttgcccttgacctggctagggagccaaggaaatgccatggttcttggtcataagacacactgcagagatctctcagtaggaaaacagggctggcccttttctttggtgatgaacacaaactgcaccctttttttctcccacgtgtccttccgctgccagccagtgttggaatctccctacccaattccagacttaattgcttactgcgtctagcacctgggtggcttcaccacctcttccttacttgtcagcagatgaatg

SEQ ID NO: 372827 - DNA, 718 bp, Homo sapiens
agatggtgaccttcgaggatgtggctgtgcacttcaccaagacagaatggactggcctttctcctgcccagagggccctgtacagaagtgtgatgttggagaattttgggaacctgactgctttgggtaaggccattttcctcctaggactcagatctgtacttttccagtttccttccttcttttacagcctggggggaggagtgtggagtggagaggagaggttgtctcttgtgtcctccactgagtgactgcagagctgaggctcagtgaccaacttcaaagattgctgggtagggagaggtcttgggtcactttggtctcccaatgaagggaattactgtcccctggtaagagtatgttccatcttccaagaggctctgcacagtaaggaataagtagtagttgttgtctggggaagggcatgtccccttccctgtgtttgctcatgccttgtggatctcactgacttacttatccttgagtgttttttttaggaagaagtcacaaatgctcagtttcctgttgatcggaatctctttggccttctccagtcgagaaccctcttctgtgggtcttattcttactgagactcctggggttttccttcttttgacacagcagatacagggctgaaaagtaccattttcttcctgttttcagggtacccagttcccaaacctgcactgatctcacttttggagagaggggacatggc

SEQ ID NO: 372828 - DNA, 677 bp, Homo sapiens
gtgcagggctccgggcgctgtgtgccgtgccctgtcccccaggctctgggtccggttgagacgcactcccaccctgggtgctgcagggtctcccgtggcctacgctgccaggaggcccaggctgggagagggagcagggcggcggcccggggtgctcttccgcgctcctcgactccagctttggtctttgtggctcaatagcttgcgcccattggaaggggaaacgcacgttgctgtcccagccacgaggccctgagcatttagcacttggtcgacgggggaagatgtgtcggtgcagctaaaagatggaatatttgcgggcgtgaagcggcccgaggtgataccacaagtcttttgacatgctgaggtctggcaggaacattaacctatgtgcatcccgagtatggaccgtgtgctcccaggctcctgacatagggtcatgaattagggccgagtgggagcgcagagcccctcccagtcacccggcagcagaagcagcccggcttttggaggacattgtctcctggagcagtgtcagtcccaaaaggtaactcagccctgcttctctcggctcagggttgacagtgacctgggaatgacttctacaacgtaattacgaattcactcagttttagaatatatttagtagtctcagaatcgctaattcatacccccat

SEQ ID NO: 372829 - DNA, 3609 bp, Homo sapiens
aggatccttaattaaattaatccctttctcccggcacttccgttcacgcaccggtttctgtttttcctgagcctttgcctgctaagagggagaccaggtcatggcagccatgcctctgaaagctcaataccaggactttccctcaagtccctacctgtcccctctgccccacactctggcccggagccagaggattggctctggggcagcaggaacctgttgttttaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagttattctctagctgaggatgatgatgttgaacaagatagatacagtgtctgttccctgcagccaccagagaagacagacatataaataaactatcaccattaagggtaacagtcaccgtgggccagacccgagctagccgacagggatgcggccacagctggccgggcgtgaccacaccgaggcgcagcgaccttgttcctagagaggcccggccgcctggtgacgcacttccggcagcgccggggagcagtccgctacggagctccagcccttctctgagacggggaccaggggatggcagccatgcacctgacagcctggccccagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgatggagtctcgctctgtcgcccaaactggagtgcagtggcaagaacttggctcaccgcaacttccgtttcccgggttcgagcaattctcctgcctcatcctcccgagtagctggaactacagtgatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaaaaaggtatgagtacatttttaattttcatgtaattgagaaaacctttctaagtattagatgaaagctagaaactatccacagggtatgtactgataaattgactactcaaaaactaaatattcctgtatgtttttgttttaaagtttaaaagataaagcgcaaaatgggg

SEQ ID NO: 372830 - DNA, 3525 bp, Homo sapiens
aggatccttaattaaattaatccctttctcccggcacttccgttcacgcaccggtttctgtttttcctgagcctttgcctgctaagagggagaccaggtcatggcagccatgcctctgaaagctcaataccaggactttccctcaagtccctacctgtcccctctgccccacactctggcccggagccagaggattggctctggggcagcaggaacctgttgttttaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagttattctctagctgaggatgatgatgttgaacaagatagatacagtgtctgttccctgcagccaccagagaagacagacatataaataaactatcaccattaagggtaacagtcaccgtgggccagacccgagctagccgacagggatgcggccacagctggccgggcgtgaccacaccgaggcgcagcgaccttgttcctagagaggcccggccgcctggtgacgcacttccggcagcgccggggagcagtccgctacggagctccagcccttctctgagacggggaccaggggatggcagccatgcacctgacagcctggccccagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgatggagtctcgctctgtcgcccaaactggagtgcagtggcaagaacttggctcaccgcaacttccgtttcccgggttcgagcaattctcctgcctcatcctcccgagtagctggaactacagtgatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaaaaaggtatgagtacatttttaattttcatgtaattgagaaaacctttctaagtattagatgaaagctagaaactatccacagggtatgtactgataaattgactactcaaaaactaaatattcctgtatgtttttgttttaaagtttaaaagataaagcgcaaaatgggg

SEQ ID NO: 372831 - DNA, 3190 bp, Homo sapiens
acgcacttccggcctcctaaccgttctcgcgtagcggtgcgcttctggcctgttttgagtccgcgctcaaaggtgccaaagtgcaaggacccacagttgggcggagcttgggttgggagtgagacagcatagcagtccaggctggtcctttgagcgcagctcaaagaaggggacggggagggcgtcactatacaattgtggccgggtgggacctgggctgtttgctcttggaggctgtacagctgcaagctttgccgctcacgaactggagctggagaaagagccccccaaggatgggaggatgacagaagtgtctgcagatggcactgcctgggcaccaggagaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgagcctttgcctgctaagagggagaccaggtcatggcagccatgcctctgaaagctcaataccaggactttccctcaagtccctacctgtcccctctgccccacactctggcccggagccagaggattggctctggggcagcaggaacctgttgttttaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagatgttgagaccaacattgacagtgagtccacattaatccagggaatttctgaagaaagagatgggatgatgtcacatggtcagctgaagagtgtccctcagagaactgacttcccagaaacacgtaatgtggaaaagcaccaggacatccccacagtgaaaaatatccaaggaaaggttccaagaatcccctgtgcaaggaaacctttcatatgtgaggagtgtgggaaatccttcagctacttttcttactatgctagacaccagagaatccacactggggagaaaccttttgagtgtagtgagtgtggaaaagcctttaatggtaattcttcgttaattcggcaccagaggattcacactggagagagaccctatcagtgtgaggagtgtgggcgagcctttaatgataatgcaaatctgatcaggcatcagagaatccacagtgggggacagaccctattactgtacagagtgtgggaatagtttcaccagtagttccgagtttgttatacatcagagaatccacactggggagaaaccgtatgagtgtaatgagtgtggcaaagcttttgttggtaattcacccctacttcggcatcagaaaatccacactggagagaaaccctatgagtgtaatgagtgtggcaaaagctttggaaggacttcccatctaagccaacatcagcgtattcacacaggggaaaagccttattcttgtaaagtatgtggacaagccttcaattttcatacaaaactaactcggcaccagagaattcacagtgaggagaaaccctttgactgtgtagattgtggaaaagccttcagtgctcaggaacaattaaaaaggcatctgagaattcatactcaggagtcttcctatgtatgtgatgagtgtggaaaagccttgactagcaaaagaaatcttcatcagcatcaaagaatccatactggagagaaaccctatgagtgtagcaagtatgagaaggcctttgggacttcttcccagctaggtcaccttgagcatgtctactctggagagaagcctgtgctggacatttgtcgttttggcctcccagaattttttacccccttttactggtaatagtacactccagtgaaatgtactgagtggattccgtcttctactcaggaatggaatgtgtgacacaggcctgactcagcctctgatccatccctcaagccacagttaatgattcagatgtcagtagatgaccaaagatggttcaattagagtcccaggattgcaagagctaataggaacaaatactctccccccgcccacccccattggttttaatgctgagaagaagaactagactcttacagaggtgagaatgaagtccacacagcaaaaatgcatctgagaattggagagcagtaaaagactgaagataatgtttgaacagccacatacaccatgcctgaagctaaaaatatatacgggtttttgaattgcagcagccaataaattccatttttgtttggttggttttggctttggcacacctgaattaggttttcttgccttggaacagaattttgacttaaacagtgttgtcattgtagcagttgtttgaagttttcagggataacatacctgatggagaaatgttttgtgtgtatgatatatgggaaagtctttagttatagtcatggcagctcctcaaccccatgattgtgatgagattgggaagcccactgtaacactggagagcccaggttatatcagacaccactagtagatagaagttctaacaacttgagctctgtaacaaaaatctcattgtactacaaaattatgtctgcaccagtgaatccattctcaagaaaagtcttaactaggaaactaaaagctttcactcttaaagctttcattttctgtttattcagttttttatttggaatggatgctactctaggccttaaactgagaaatgccaggctattgtagctattatatcttggtatttgccattttaattcctaggacagcacgcccgctttgcccttgacctggctagggagccaaggaaatgccatggttcttggtcataagacacactgcagagatctctcagtaggaaaacagggctggcccttttctttggtgatgaacacaaactgcaccctttttttctcccacgtgtccttccgctgccagccagtgttggaatctccctacccaattccagacttaattgcttactgcgtctagcacctgggtggcttcaccacctcttccttacttgtcagcagatgaatg

SEQ ID NO: 372832 - DNA, 3435 bp, Homo sapiens
aggatccttaattaaattaatccctttctcccggcacttccgttcacgcaccggtttctgtttttcctgagcctttgcctgctaagagggagaccaggtcatggcagccatgcctctgaaagctcaataccaggactttccctcaagtccctacctgtcccctctgccccacactctggcccggagccagaggattggctctggggcagcaggaacctgttgttttaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagttattctctagctgaggatgatgatgttgaacaagatagatacagtgtctgttccctgcagccaccagagaagacagacatataaataaactatcaccattaagggtaacagtcaccgtgggccagacccgagctagccgacagggatgcggccacagctggccgggcgtgaccacaccgaggcgcagcgaccttgttcctagagaggcccggccgcctggtgacgcacttccggcagcgccggggagcagtccgctacggagctccagcccttctctgagacggggaccaggggatggcagccatgcacctgacagcctggccccagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgatggagtctcgctctgtcgcccaaactggagtgcagtggcaagaacttggctcaccgcaacttccgtttcccgggttcgagcaattctcctgcctcatcctcccgagtagctggaactacagtgatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggagttcccgaggcagaacatttggttcttctgtcaggtccagttcaccaacaagattatgaatggatggagacagcgtccagcgttggtctaggaagcccaaaccgcagggcaaggtcgtcagcaggccttagttggtgtgttgattttttgacagcgtgcatggagtacttttggagcagtgcaggagcccccctttatttcgcg

SEQ ID NO: 372833 - DNA, 3638 bp, Homo sapiens
ctctcaaatttccgcccgtagtaggcatggcggcggcacctcaccactgattcgttgaattccttcccggtaatcttgggcactagcgggcggagttgaagggcgcttggaccccagcggcgatctgtgtttgggttcgcgctctgggagaattttggctttgctcgccttcctctttcagaagactcgaaatcggccagcaggtctgcgagatttgaaacgcgactgttactccttgttttccggttctggccgcgggagcctctcgagaagcgtggaaagaggagaagggcgtataccttgtgaccgcctctggttgtcttgggctcgcgcctggcgccgctacgtggagtcgctctctcgtcgtcacttttggctgccgacttgttgagtagaagtgcagactgatgctttaagactcagggagaggtctttcccttatctccaccccagcaagcaccccagagaccttggagatttgtcttgtttctagacacgtgtactccaatgttgtgcggaggaggccttaaatattcgagaagagagtgggaactcctggaattttaagggatttctgtgtatttccaaaactgacttttaactaccggcagcgtgggatttcgtgattgtttttcgccatcgtgtggctccaacatgtacttcccttcttggttaagtcagctgtacaggggtttatccagacccatcagaaggaccacccaaccgatctggggttctctctacagaagtctgttgcagagttcacagaggagaattccagaattcagtagctttgttgtccggaccaacacatgtggagagttgcgttcgtctcacttaggccaagaagtcaccttgtgtggatggattcagtaccgaaggcaaaacacattcttggtcctaagagatttcgatgggcttgttcaagttatcattccccaggatgagtcggcagcctctgtgaagaagattttatgtgaagcccctgtggaatctgtggtgcaagtgtctggtacagtcatttcccgtcctgcaggacaagagaatccaaaaatgccaacaggtgagattgaaatcaaagttaaaacagctgagcttctgaatgcctgcaagaagctgccctttgaaattaagaacttcgtgaagaaaacagaggctcttcggttgcagtatcgctacttagacttgcgtagtttccaaatgcagtataacctgcgactgaggtcccagatggtcatgaaaatgcgggaatatctctgtaatctgcatgggtttgtggatatagaaacccccacattgtttaagaggaccccagggggtgccaaagagtttttagtaccatccagggaacctggaaagttttattctctccctcagagtcctcaacagtttaagcaacttctgatggttggcggtttagacagatattttcaggttgcccgatgttatcgagatgaaggttcaagaccagacagacagcctgagtttactcagattgacatagagatgtcatttgtagaccagactgggatccagagtttaattgagggtttgctccagtattcctggcccaatgacaaagatcctgtggttgttccttttcctactatgacttttgctgaggtgctggccacctatggaactgataaacctgacactcgctttggaatgaagattatagatatcagtgatgtgtttagaaacacagagattggatttcttcaagatgcacttagtaagccccatggaactgtgaaagccatatgtatccctgaaggagcaaaatacttaaaaaggaaagacattgaatccattagaaactttgcagctgaccattttaatcaggaaatcttacctgtattccttaacgccaatagaaactggaattctccagttgctaatttcataatggagtcacaaagactggaattaatcagactaatggagacccaagaggaagatgtggtcctactaactgctggagagcacaataaagcatgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctccccaccccagtgacatacatctcctgtacactgagcccaaaaaggaggatgtgaaaatgctctcccatctgctccaggctttagattatggggcaccccctcatggaggaattgccttagggttagacagactgatatgccttgtcactggatctccaagcatcagagatgtcatagccttcccaaagtccttccggggacatgacctcatgagcaataccccagattctgtccctcctgaggaactgaagccctatcatatccgagtctccaagccaacagactccaaagcagaaagagctcattgaatcatgcataccatgcagaaagttgagcttttaggttttgtcctctttgcttccccaaggctaaagtcagatctagagttctgccacaggtctaacaatcaagtctttagatggaaggaatccaggcaacattcttcaccacaacgaagaaacagataaaagatacccaattttgacttgatttcatgcatcatttggattttttttggttaggactttttttgaagttcctttttacttaggtgtgaaagatggttctttgttgaaataatatagtggtttagtgttttcaaatcatgtttctcatacccagatagtagattattcacttaggacagaggtaatcaaattatgtgtgaaatgtaggaaaatgcttgcccctgtaaactagtgagttgatggagcatttgcttcatcatcctcatcaagagaatcatataaattaagctttataatgacatttcaaccatcaacataatatagtgaggagtagcataatattttttaataatgcagaaaacatcactgaaatgagagtcacaaatttttcttcagtgtttcagcctgagtaagttacataaacctcgcttagcctcccttcctgctaatgtgtaaaatacatacttgccctggctacctcaccgggctgttattgctggaatcagaggagataacatatatggaagataaagtgaataaaagtactttgaaaaactataaagcattccacaaatatgagatgatggtattatccatccataaataggtagatatatctctattttatagtttcagattaaacaaaactgatatcaatagtaaaagtcattttacttatcaattttctgtttttttttttagttttaaagatattattggccgggagtggtggctcacacctgtaatcccagcactttgggagattgaggtgggtggatcacttgaggtcaggagttcaacaccagcctggccaacatagtgaaaccgtctctactaaaaacacaaaaattagccaggcatggtggcgcatgcctgtgatcgcagccactcgggaggctgaggcatgaggtttgcttgaacctgggagatggaggttgcagtgagccaagatggtgccattacactccagcctgggtgacagagcaagactccatctc

SEQ ID NO: 372834 - DNA, 2607 bp, Homo sapiens
ctctcaaatttccgcccgtagtaggcatggcggcggcacctcaccactgattcgttgaattccttcccggtaatcttgggcactagcgggcggagttgaagggcgcttggaccccagcggcgatctgtgtttgggttcgcgctctgggagaattttggctttgctcgccttcctctttcagaagactcgaaatcggccagcaggtctgcgagatttgaaacgcgactgttactccttgttttccggttctggccgcgggagcctctcgagaagcgtggaaagaggagaagggcgtataccttgtgaccgcctctggttgtcttgggctcgcgcctggcgccgctacgtggagtcgctctctcgtcgtcacttttggctgccgacttgttgagtagaagtgcagactgatgctttaagactcagggagaggtctttcccttatctccaccccagcaagcaccccagagaccttggagatttgtcttgtttctagacacgtgtactccaatgttgtgcggaggaggccttaaatattcgagaagagagtgggaactcctggaattttaagggatttctgtgtatttccaaaactgacttttaactaccggcagcgtgggatttcgtgattgtttttcgccatcgtgtggctccaacatgtacttcccttcttggttaagtcagctgtacaggggtttatccagacccatcagaaggaccacccaaccgatctggggttctctctacagaagtctttgctaatttcataatggagtcacaaagactggaattaatcagactaatggagacccaagaggaagatgtggtcctactaactgctggagagcacaataaagcatgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctccccaccccagtgacatacatctcctgtacactgagcccaaaaaggcccgtagccaacactatgacttggttttaaatggcaatgaaataggaggtggttcaattcgaattcacaatgcagagctgcagcgttatatcctggcaaccttactaaaggaggatgtgaaaatgctctcccatctgctccaggctttagattatggggcaccccctcatggaggaattgccttagggttagacagactgatatgccttgtcactggatctccaagcatcagagatgtcatagccttcccaaagtccttccggggacatgacctcatgagcaataccccagattctgtccctcctgaggaactgaagccctatcatatccgagtctccaagccaacagactccaaagcagaaagagctcattgaatcatgcataccatgcagaaagttgagcttttaggttttgtcctctttgcttccccaaggctaaagtcagatctagagttctgccacaggtctaacaatcaagtctttagatggaaggaatccaggcaacattcttcaccacaacgaagaaacagataaaagatacccaattttgacttgatttcatgcatcatttggattttttttggttaggactttttttgaagttcctttttacttaggtgtgaaagatggttctttgttgaaataatatagtggtttagtgttttcaaatcatgtttctcatacccagatagtagattattcacttaggacagaggtaatcaaattatgtgtgaaatgtaggaaaatgcttgcccctgtaaactagtgagttgatggagcatttgcttcatcatcctcatcaagagaatcatataaattaagctttataatgacatttcaaccatcaacataatatagtgaggagtagcataatattttttaataatgcagaaaacatcactgaaatgagagtcacaaatttttcttcagtgtttcagcctgagtaagttacataaacctcgcttagcctcccttcctgctaatgtgtaaaatacatacttgccctggctacctcaccgggctgttattgctggaatcagaggagataacatatatggaagataaagtgaataaaagtactttgaaaaactataaagcattccacaaatatgagatgatggtattatccatccataaataggtagatatatctctattttatagtttcagattaaacaaaactgatatcaatagtaaaagtcattttacttatcaattttctgtttttttttttagttttaaagatattattggccgggagtggtggctcacacctgtaatcccagcactttgggagattgaggtgggtggatcacttgaggtcaggagttcaacaccagcctggccaacatagtgaaaccgtctctactaaaaacacaaaaattagccaggcatggtggcgcatgcctgtgatcgcagccactcgggaggctgaggcatgaggtttgcttgaacctgggagatggaggttgcagtgagccaagatggtgccattacactccagcctgggtgacagagcaagactccatctc

SEQ ID NO: 372835 - DNA, 411 bp, Homo sapiens
tgttttaaaactcaactttgtttcccctttatcatctaagcctagatggtggcacttagtggaccttcaaaatatatttaaactgaattatcttttgaatttcaggaggatgtgaaaatgctctcccatctgctccaggctttagattatggggcaccccctcatggaggaattgccttaggtaaacaacttttccttttataagataaactgaattccattgcactgtctcaaattcaggttctcagtttgtgttggtagaggtggaaggatgagtccaagagttccatgagaatgtaagtttctgttgaaatttcagtaatatattttttaaatatatcttaacagttataaagatataacttaactgataatttgcatttgaaagatcattaatagcttaaaactgca

SEQ ID NO: 372836 - DNA, 3749 bp, Homo sapiens
ctctcaaatttccgcccgtagtaggcatggcggcggcacctcaccactgattcgttgaattccttcccggtaatcttgggcactagcgggcggagttgaagggcgcttggaccccagcggcgatctgtgtttgggttcgcgctctgggagaattttggctttgctcgccttcctctttcagaagactcgaaatcggccagcaggtctgcgagatttgaaacgcgactgttactccttgttttccggttctggccgcgggagcctctcgagaagcgtggaaagaggagaagggcgtataccttgtgaccgcctctggttgtcttgggctcgcgcctggcgccgctacgtggagtcgctctctcgtcgtcacttttggctgccgacttgttgagtagaagtgcagactgatgctttaagactcagggagaggtctttcccttatctccaccccagcaagcaccccagagaccttggagatttgtcttgtttctagacacgtgtactccaatgttgtgcggaggaggccttaaatattcgagaagagagtgggaactcctggaattttaagggatttctgtgtatttccaaaactgacttttaactaccggcagcgtgggatttcgtgattgtttttcgccatcgtgtggctccaacatgtacttcccttcttggttaagtcagctgtacaggggtttatccagacccatcagaaggaccacccaaccgatctggggttctctctacagaagtctgttgcagagttcacagaggagaattccagaattcagtagctttgttgtccggaccaacacatgtggagagttgcgttcgtctcacttaggccaagaagtcaccttgtgtggatggattcagtaccgaaggcaaaacacattcttggtcctaagagatttcgatgggcttgttcaagttatcattccccaggatgagtcggcagcctctgtgaagaagattttatgtgaagcccctgtggaatctgtggtgcaagtgtctggtacagtcatttcccgtcctgcaggacaagagaatccaaaaatgccaacaggtgagattgaaatcaaagttaaaacagctgagcttctgaatgcctgcaagaagctgccctttgaaattaagaacttcgtgaagaaaacagaggctcttcggttgcagtatcgctacttagacttgcgtagtttccaaatgcagtataacctgcgactgaggtcccagatggtcatgaaaatgcgggaatatctctgtaatctgcatgggtttgtggatatagaaacccccacattgtttaagaggaccccagggggtgccaaagagtttttagtaccatccagggaacctggaaagttttattctctccctcagagtcctcaacagtttaagcaacttctgatggttggcggtttagacagatattttcaggttgcccgatgttatcgagatgaaggttcaagaccagacagacagcctgagtttactcagattgacatagagatgtcatttgtagaccagactgggatccagagtttaattgagggtttgctccagtattcctggcccaatgacaaagatcctgtggttgttccttttcctactatgacttttgctgaggtgctggccacctatggaactgataaacctgacactcgctttggaatgaagattatagatatcagtgatgtgtttagaaacacagagattggatttcttcaagatgcacttagtaagccccatggaactgtgaaagccatatgtatccctgaaggagcaaaatacttaaaaaggaaagacattgaatccattagaaactttgcagctgaccattttaatcaggaaatcttacctgtattccttaacgccaatagaaactggaattctccagttgctaatttcataatggagtcacaaagactggaattaatcagactaatggagacccaagaggaagatgtggtcctactaactgctggagagcacaataaagcatgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctccccaccccagtgacatacatctcctgtacactgagcccaaaaaggcccgtagccaacactatgacttggttttaaatggcaatgaaataggaggtggttcaattcgaattcacaatgcagagctgcagcgttatatcctggcaaccttactaaaggaggatgtgaaaatgctctcccatctgctccaggctttagattatggggcaccccctcatggaggaattgccttagggttagacagactgatatgccttgtcactggatctccaagcatcagagatgtcatagccttcccaaagtccttccggggacatgacctcatgagcaataccccagattctgtccctcctgaggaactgaagccctatcatatccgagtctccaagccaacagactccaaagcagaaagagctcattgaatcatgcataccatgcagaaagttgagcttttaggttttgtcctctttgcttccccaaggctaaagtcagatctagagttctgccacaggtctaacaatcaagtctttagatggaaggaatccaggcaacattcttcaccacaacgaagaaacagataaaagatacccaattttgacttgatttcatgcatcatttggattttttttggttaggactttttttgaagttcctttttacttaggtgtgaaagatggttctttgttgaaataatatagtggtttagtgttttcaaatcatgtttctcatacccagatagtagattattcacttaggacagaggtaatcaaattatgtgtgaaatgtaggaaaatgcttgcccctgtaaactagtgagttgatggagcatttgcttcatcatcctcatcaagagaatcatataaattaagctttataatgacatttcaaccatcaacataatatagtgaggagtagcataatattttttaataatgcagaaaacatcactgaaatgagagtcacaaatttttcttcagtgtttcagcctgagtaagttacataaacctcgcttagcctcccttcctgctaatgtgtaaaatacatacttgccctggctacctcaccgggctgttattgctggaatcagaggagataacatatatggaagataaagtgaataaaagtactttgaaaaactataaagcattccacaaatatgagatgatggtattatccatccataaataggtagatatatctctattttatagtttcagattaaacaaaactgatatcaatagtaaaagtcattttacttatcaattttctgtttttttttttagttttaaagatattattggccgggagtggtggctcacacctgtaatcccagcactttgggagattgaggtgggtggatcacttgaggtcaggagttcaacaccagcctggccaacatagtgaaaccgtctctactaaaaacacaaaaattagccaggcatggtggcgcatgcctgtgatcgcagccactcgggaggctgaggcatgaggtttgcttgaacctgggagatggaggttgcagtgagccaagatggtgccattacactccagcctgggtgacagagcaagactccatctc

SEQ ID NO: 372837 - DNA, 3901 bp, Homo sapiens
ctctcaaatttccgcccgtagtaggcatggcggcggcacctcaccactgattcgttgaattccttcccggtaatcttgggcactagcgggcggagttgaagggcgcttggaccccagcggcgatctgtgtttgggttcgcgctctgggagaattttggctttgctcgccttcctctttcagaagactcgaaatcggccagcaggtctgcgagatttgaaacgcgactgttactccttgttttccggttctggccgcgggagcctctcgagaagcgtggaaagaggagaagggcgtataccttgtgaccgcctctggttgtcttgggctcgcgcctggcgccgctacgtggagtcgctctctcgtcgtcacttttggctgccgacttgttgagtagaagtgcagactgatgctttaagactcagggagaggtctttcccttatctccaccccagcaagcaccccagagaccttggagatttgtcttgtttctagacacgtgtactccaatgttgtgcggaggaggccttaaatattcgagaagagagtgggaactcctggaattttaagggatttctgtgtatttccaaaactgacttttaactaccggcagcgtgggatttcgtgattgtttttcgccatcgtgtggctccaacatgtacttcccttcttggttaagtcagctgtacaggggtttatccagacccatcagaaggaccacccaaccgatctggggttctctctacagaagtctgttgcagagttcacagaggagaattccagaattcagtagctttgttgtccggaccaacacatgtggagagttgcgttcgtctcacttaggccaagaagtcaccttgtgtggatggattcagtaccgaaggcaaaacacattcttggtcctaagagatttcgatgggcttgttcaagttatcattccccaggatgagtcggcagcctctgtgaagaagattttatgtgaagcccctgtggaatctgtggtgcaagtgtctggtacagtcatttcccgtcctgcaggacaagagaatccaaaaatgccaacaggtgagattgaaatcaaagttaaaacagctgagcttctgaatgcctgcaagaagctgccctttgaaattaagaacttcgtgaagaaaacagaggctcttcggttgcagtatcgctacttagacttgcgtagtttccaaatgcagtataacctgcgactgaggtcccagatggtcatgaaaatgcgggaatatctctgtaatctgcatgggtttgtggatatagaaacccccacattgtttaagaggaccccagggggtgccaaagagtttttagtaccatccagggaacctggaaagttttattctctccctcagagtcctcaacagtttaagcaacttctgatggttggcggtttagacagatattttcaggttgcccgatgttatcgagatgaaggttcaagaccagacagacagcctgagtttactcagattgacatagagatgtcatttgtagaccagactgggatccagagtttaattgagggtttgctccagtattcctggcccaatgacaaagatcctgtggttgttccttttcctactatgacttttgctgaggtgctggccacctatggaactgataaacctgacactcgctttggaatgaagattatagatatcagtgatgtgtttagaaacacagagattggatttcttcaagatgcacttagtaagccccatggaactgtgaaagccatatgtatccctgaaggagcaaaatacttaaaaaggaaagacattgaatccattagaaactttgcagctgaccattttaatcaggaaatcttacctgtattccttaacgccaatagaaactggaattctccagttgctaatttcataatggagtcacaaagactggaattaatcagactaatggagacccaagaggaagatgtggtcctactaactgctggagagcacaataaagcatgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctccccaccccagtgacatacatctcctgtacactgagcccaaaaaggcccgtagccaacactatgacttggttttaaatggcaatgaaataggaggtggttcaattcgaattcacaatgcagagctgcagcgttatatcctggcaaccttactaaaggaggatgtgaaaatgctctcccatctgctccaggctttagattatggggcaccccctcatggaggaattgccttagggttagacagactgatatgccttgtcactggatctccaagcatcagagatgtcatagccttcccaaagtccttccggggacatgacctcatgagcaataccccagattctgtccctcctgaggaactgaagccctatcatatccgagtctccaagccaacagactccaaagcagaaagagctcattgaatcatgcataccatgcagaaagttgagcttttaggttttgtcctctttgcttccccaaggctaaagtcagatctagagttctgccacaggtctaacaatcaagtctttagatggaaggaatccaggcaacattcttcaccacaacgaagaaacagataaaagatacccaattttgacttgatttcatgcatcatttggattttttttggttaggactttttttgaagttcctttttacttaggtgtgaaagatggttctttgttgaaataatatagtggtttagtgttttcaaatcatgtttctcatacccagatagtagattattcacttaggacagaggtaatcaaattatgtgtgaaatgtaggaaaatgcttgcccctgtaaactagtgagttgatggagcatttgcttcatcatcctcatcaagagaatcatataaattaagctttataatgacatttcaaccatcaacataatatagtgaggagtagcataatattttttaataatgcagaaaacatcactgaaatgagagtcacaaatttttcttcagtgtttcagcctgagtaagttacataaacctcgcttagcctcccttcctgctaatgtgtaaaatacatacttgccctggctacctcaccgggctgttattgctggaatcagaggagataacatatatggaagataaagtgaataaaagtactttgaaaaactataaagcattccacaaatatgagatgatggtattatccatccataaataggtagatatatctctattttatagtttcagattaaacaaaactgatatcaatagtaaaagtcattttacttatcaattttctgtttttttttttagttttaaagatattattggccgggagtggtggctcacacctgtaatcccagcactttgggagattgaggtgggtgggattacaggcatgaaccaccacgcccagccttcttttttcctttgagacagtctcaccctggcacccaggctggagtgcagtggcaggatcacgggtctctgcaacctcagcctcccaggttcagttcccctgcctcagcctcccgaatagctgggactacaatagcccaccactacacccggctagatttttgtatttttagtagagatggggtttcaccatgttggccaggttggtcttgaaatcctgacctcaggtaatctgcccacctcagcacccagccaggtggtggtagttgttttacagcctgtgtgagacattcgggtgagccccaggaaatgaaagaatgtgcttatttgggggagggggagg

SEQ ID NO: 372838 - DNA, 3920 bp, Homo sapiens
ctctcaaatttccgcccgtagtaggcatggcggcggcacctcaccactgattcgttgaattccttcccggtaatcttgggcactagcgggcggagttgaagggcgcttggaccccagcggcgatctgtgtttgggttcgcgctctgggagaattttggctttgctcgccttcctctttcagaagactcgaaatcggccagcaggtctgcgagatttgaaacgcgactgttactccttgttttccggttctggccgcgggagcctctcgagaagcgtggaaagaggagaagggcgtataccttgtgaccgcctctggttgtcttgggctcgcgcctggcgccgctacgtggagtcgctctctcgtcgtcacttttggctgccgacttgttgagtagaagtgcagactgatgctttaagactcagggagaggtctttcccttatctccaccccagcaagcaccccagagaccttggagatttgtcttgtttctagacacgtgtactccaatgttgtgcggaggaggccttaaatattcgagaagagagtgggaactcctggaattttaagggatttctgtgtatttccaaaactgacttttaactaccggcagcgtgggatttcgtgattgtttttcgccatcgtgtggctccaacatgtacttcccttcttggttaagtcagctgtacaggggtttatccagacccatcagaaggaccacccaaccgatctggggttctctctacagaagtctgttgcagagttcacagaggagaattccagaattcagtagctttgttgtccggaccaacacatgtggagagttgcgttcgtctcacttaggccaagaagtcaccttgtgtggatggattcagtaccgaaggcaaaacacattcttggtcctaagagatttcgatgggcttgttcaagttatcattccccaggatgagtcggcagcctctgtgaagaagattttatgtgaagcccctgtggaatctgtggtgcaagtgtctggtacagtcatttcccgtcctgcaggacaagagaatccaaaaatgccaacaggtgagattgaaatcaaagttaaaacagctgagcttctgaatgcctgcaagaagctgccctttgaaattaagaacttcgtgaagaaaacagaggctcttcggttgcagtatcgctacttagacttgcgtagtttccaaatgcagtataacctgcgactgaggtcccagatggtcatgaaaatgcgggaatatctctgtaatctgcatgggtttgtggatatagaaacccccacattgtttaagaggaccccagggggtgccaaagagtttttagtaccatccagggaacctggaaagttttattctctccctcagagtcctcaacagtttaagcaacttctgatggttggcggtttagacagatattttcaggttgcccgatgttatcgagatgaaggttcaagaccagacagacagcctgagtttactcagattgacatagagatgtcatttgtagaccagactgggatccagagtttaattgagggtttgctccagtattcctggcccaatgacaaagatcctgtggttgttccttttcctactatgacttttgctgaggtgctggccacctatggaactgataaacctgacactcgctttggaatgaagattatagatatcagtgatgtgtttagaaacacagagattggatttcttcaagatgcacttagtaagccccatggaactgtgaaagccatatgtatccctgaaggagcaaaatacttaaaaaggaaagacattgaatccattagaaactttgcagctgaccattttaatcaggaaatcttacctgtattccttaacgccaatagaaactggaattctccagttgctaatttcataatggagtcacaaagactggaattaatcagactaatggagacccaagaggaagatgtggtcctactaactgctggagagcacaataaagcatgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctccccaccccagtgacatacatctcctgtacactgagcccaaaaaggaggatgtgaaaatgctctcccatctgctccaggctttagattatggggcaccccctcatggaggaattgccttagggttagacagactgatatgccttgtcactggatctccaagcatcagagatgtcatagccttcccaaagtccttccggggacatgacctcatgagcaataccccagattctgtccctcctgaggaactgaagccctatcatatccgagtctccaagccaacagactccaaagcagaaagagctcattgaatcatgcataccatgcagaaagttgagcttttaggttttgtcctctttgcttccccaaggctaaagtcagatctagagttctgccacaggtctaacaatcaagtctttagatggaaggaatccaggcaacattcttcaccacaacgaagaaacagataaaagatacccaattttgacttgatttcattcccttcctcgtgctcggcgttgagctcctgcagccgccgccgctgcagtggtcgtccctgccctccccggccccggggtgcaccccgcaaggctcccgctggtgtccctggagcatgggaggctgctgagcgtgagtggcggtgtctggcaggagctgcgtggcagggagggcgtccatggctgcagccaacaagggcaacaagcccagagtccggagtatccgctttgcggcaggccacgatgcagaaggatcccacggccacgtccactttgatgagaagctgcatgactcggtggtcatggtcacccaggagagtgacagcagctttctggtcaaggttggcttcctgaagatcctgcacaggtatgagattaccttcactctgcccccagtgcacaggctgagcaaggatgtccgcgaggcacctgtccccagcctgcacctcaagcccctcagcgtggtgcccgtccctgaaggttatagtgtcaagtgtgagtactcggcgcacaaagagggcgtcctcaaagaggagatactgctagcctgcgaaggtggcactggcacctgtgtgcgcgtgacggtgcaggcccgcgtcatggaccggcaccacggcacgcccatgctgctggatggtgtcaagtgtgtgggcgccgagctggaatacgactcagagcacagcgactggcacggctttgactgaggcccgaggccccgcctgccccgggcccctcagccttaaaccccgccttgtccccccgacatgctgcgtgatggtgtggcttcctcgcccctttctggggtgggtgtgggggtggagtggccttgcccacgcctctcacctctgccttcatttgtgctgccaccctgcccctccctcgtcctcctctcccacttcctcctctctgtgtgcctcagtctcctgccggaagaaatgggttgagcccgaaaggaggctgtctgaggaagggagagggagggcctggggtgggtcccccactccccaccccaagccacagggactcccaccagggtctgggagaggacggagctggctctgtggcgtcgtggccccattactgctgccttgcttcagccacctctcctgcccctccctagtccccactgctgtccaccatgagtaggagggaggtgcagtccccagccccctcccctcaggtctgtgttacttggtttttaagcgactggttgggatagaaccctaaagaaataaacttccagtggataccgg

SEQ ID NO: 372839 - DNA, 2644 bp, Homo sapiens
ctctcaaatttccgcccgtagtaggcatggcggcggcacctcaccactgattcgttgaattccttcccggtaatcttgggcactagcgggcggagttgaagggcgcttggaccccagcggcgatctgtgtttgggttcgcgctctgggagaattttggctttgctcgccttcctctttcagaagactcgaaatcggccagcaggtctgcgagatttgaaacgcgactgttactccttgttttccggttctggccgcgggagcctctcgagaagcgtggaaagaggagaagggcgtataccttgtgaccgcctctggttgtcttgggctcgcgcctggcgccgctacgtggagtcgctctctcgtcgtcacttttggctgccgacttgttgagtagaagtgcagactgatgctttaagactcagggagaggtctttcccttatctccaccccagcaagcaccccagagaccttggagatttgtcttgtttctagacacgtgtactccaatgttgtgcggaggaggccttaaatattcgagaagagagtgggaactcctggaattttaagggatttctgtgtatttccaaaactgacttttaactaccggcagcgtgggatttcgtgattgtttttcgccatcgtgtggctccaacatgtacttcccttcttggttaagtcagctgtacaggggtttatccagacccatcagaaggaccacccaaccgatctggggttctctctacagaagtctgttgcagagttcacagaggagaattccagaattcagtagctttgttgtccggaccaacacatgtggagagttgcgttcgtctcacttaggccaagaagtcaccttgtgtggatggattcagtaccgaaggcaaaacacattcttggtcctaagagatttcgatgggcttgttcaagttatcattccccaggatgagtcggcagcctctgtgaagaagattttatgtgaagcccctgtggaatctgtggtgcaagtgtctggtacagtcatttcccgtcctgcaggacaagagaatccaaaaatgccaacaggtgagattgaaatcaaagttaaaacagctgagcttctgaatgcctgcaagaagctgccctttgaaattaagaacttcgtgaagaaaacagaggctcttcggttgcagtatcgctacttagacttgcgtagtttccaaatgcagtataacctgcgactgaggtcccagatggtcatgaaaatgcgggaatatctctgtaatctgcatgggtttgtggatatagaaacccccacattgtttaagaggaccccagggggtgccaaagagtttttagtaccatccagggaacctggaaagttttattctctccctcagagtcctcaacagtttaagcaacttctgatggttggcggtttagacagatattttcaggttgcccgatgttatcgagatgaaggttcaagaccagacagacagcctgagtttactcagattgacatagagatgtcatttgtagaccagactgggatccagagtttaattgagggtttgctccagtattcctggcccaatgacaaagatcctgtggttgttccttttcctactatgacttttgctgaggtgctggccacctatggaactgataaacctgacactcgctttggaatgaagattatagatatcagtgatgtgtttagaaacacagagattggatttcttcaagatgcacttagtaagccccatggaactgtgaaagccatatgtatccctgaaggagcaaaatacttaaaaaggaaagacattgaatccattagaaactttgcagctgaccattttaatcaggaaatcttacctgtattccttaacgccaatagaaactggaattctccagttgctaatttcataatggagtcacaaagactggaattaatcagactaatggagacccaagaggaagatgtggtcctactaactgctggagagcacaataaagcaaaaaagtttcagagttcagcttcaaagctaaatgtaatcccccgtctccccttcccctacaatagtaaaatgaagaaagctatttatttccaaattttattatgaatgcatttcttaaaaaagaacatgggattttgttcctaactaatttggctattaaaccttctcttggtatgaactaaacatgctggtgtttcattctcaggaagttataggtctgattcctacaaggccttccttgaaagagagctagaaaccagactttcgaggaataacattaacattctgaaaatgtcacaatgaaggtccgttatgtagacgtaaatgtaagatagaatgggctgcaaaataataccctatcatgtctctaggcatatgtcactgttctaaccagctgtcctttctcagggaagtcctgcataccataggtagcacttattaagcacttagtatttgccaagcccgttctaagcactttgtatacattaactcatttaatcctcatgccaaccctatgaaagaagttctgatactgttgctattttaaaaataagaaaagtgagtcacagagcttaaaattttgctcacagtcacacagctaggaagtggaggagccggatttctaacccatgaagttgggttccaa

SEQ ID NO: 372840 - DNA, 464 bp, Homo sapiens
agctgtgacttgagagcctaagctcttagcctttttgagacggagtcttgctctgtcgcccaggctggagtgcagtagcatgatatccgctcactgcaagctccacctccagggttcacgccgttcccctcctcagcctctcgctacaggcccccgccaccacgcctggctaatttttttttttttgtatttttagtagagacggggtttcaccctgtcagccaggatggtcttgatctcctgacctcgtgatctgcccgcctcagtctcccaaagtgctgggatcacaggcatgaggcaccgcgcccggcctcttagccattttttaatactgtccaacagaaactataaactccagaaagtccaagggttacctttgaatagtataattatgatttttattttacttttgttctcccaagttttcttaaatgaatacagtccttgtgttattcaaaaaaaaa

SEQ ID NO: 372841 - DNA, 410 bp, Homo sapiens
agaattactaacctatacccatgtgagaattgtatttgcacttcttgtttgaaggaaatacatacaacacaggtagcgtctctacacttcagtatacagagatctgaacagtgttctctctgagtgaatcatattgcaggacagaaattacttttaaaaattctgtaatgggtcaggcctataatcctagcactttgggaggctgaggtgggcagatcacctgaggtcaggagttcgagaccagcctggccaaaatggtaaaaccccatctctacaaaaaatacaaaaattagccaggcgtagtggtgtgtgcctgtaatcccagctactcaggaggctgaggcacgagaatcacttgaacctgggaggcagagcttgcagtgagctgagattgagccactgcactccag

SEQ ID NO: 372842 - DNA, 432 bp, Homo sapiens
gacgtcgaggttggacaatcatttgaatccgggaagcggaggttgcagtaagccgagatcgcgccacttcactccagcttgggcaacagtgagaccctgtctcgaaaaaataaattaggcagacagctaggtttggtggcacactcttgtaatgccagctactccagaggctgaagctggagggtcgcttgaatcccaggagttctgggctgcagtgcggtatgcccatccagtatccacagtaggttcatcatcaatatggcgacctccgggagtggagtggagggttgcctaaggtggggtgaactgtcccagaaacagagcaggttaaaactcatgctcttgtgctgatcagcagcgggatcgcacctatgaatagccaccacatcttcagcctaggctacatagcaggaccctagtctcaataaaaaa

SEQ ID NO: 372843 - DNA, 172 bp, Homo sapiens
gcggccgcctactactactactactctgctcgaattcaagcttctaacgagtacggggacatgcacaggcaaaatgtattcactagatttctacgtagtgatctgcttttactttgtaatttgtagttctcaaaagacttttttttaaaaaaataaagtccatacttacact

SEQ ID NO: 372844 - DNA, 480 bp, Homo sapiens
tttccccccaatgactacatacatagatgggaaaatgtggctacattttccccccaatgactacatcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacact

SEQ ID NO: 372845 - DNA, 307 bp, Homo sapiens
gctccctgaaatattttacttctagttatgagtcacctctgattaaattgggtgctttttagtgcactgatacttgtttaaaacatctaaaccctattcacaagttgaagtatgaaatctaaagccatcattatgcgtcctcaaacttgcctcctatactcttaaccaggtatacattcccaaagttcagctaggtgtggtggctcatacttgtgaccccaacactttgggagcctgaggctggaggatcgcttgagcccaagagttcaagaccggcctggactgcataaggagacctcatctctac

SEQ ID NO: 372846 - DNA, 3106 bp, Homo sapiens
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccaggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgtttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacact

SEQ ID NO: 372847 - DNA, 3309 bp, Homo sapiens
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgtttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacact

SEQ ID NO: 372848 - DNA, 2696 bp, Homo sapiens
agtggtagactagggagattggagaagtgataaactgtggcccaggaaagttcagggttaagtttgtgaggaaagtcagtaatcccatgtgattgaactatgaagggaaggatatagggggacacagtgattgaaaccagggaaggtacttctgttaattaagctattttcttttacaggagtttcagcagcttttgctgtgaagctctttaaatcatggataaatgaaaaagatatcaatgcagtagctgcaagtcttcggaaagtcagcatggataacagactgatggttggtaactttttttcattcttcccattcttgccaaggatgtaaatgagagaaatttctcatttttaagactgtgaaaagaaagtgtttttcttaatctgatttaaagaaagtttaaccagataaattcttcttttaggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgtttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacact

SEQ ID NO: 372849 - DNA, 2535 bp, Homo sapiens
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaaaaaaaaaaaaaaaaaaaaaaaaaaagaaaaaaaaaaaaaaaaaaaaaaagaaaaaaaaaaaaaaaaaaaaagaaaaaaaaaagggggggggggcggaaaaaaaatagggggggggagtggcacaaagcaacgtcgttggaaacaggggagcccaccaaagaagagagggaaactatagaagagggcagcggagccgcggaaaaacaccacggagaggaagaaaaagcgcacagcgagcttatcctgaaggagacacacaacccacactggggggaggagaaacaggaggaacaaaaacacgatagcagagaaataggcggcggcggacgacaaaacaaaagatcggcgtggtgaggggaaccacaccacgctaatgccgtgcgagaactgcgagacggaagtaataaaaatcac

SEQ ID NO: 372850 - DNA, 2175 bp, Homo sapiens
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaacatgcaagcaatggtccacgtacatcaagattcatgttaaatgaattcggtcgagc

SEQ ID NO: 372851 - DNA, 1623 bp, Homo sapiens
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagaggagctggatgaaatgtgtctgtagaggaggagctggatgaaatgtgtctgtagaggaggagctggatggaatgtgtctagagggaggagctggatgaaaggtgtcggtagaggaggagctggatggaatgtcctgtagaggaggagctggatgaaatgtgtctgtgggaggaggagctggatgaaatgaaatgtgtctgtcgaggaggagctggatgaaatgtgt

SEQ ID NO: 372852 - DNA, 1048 bp, Homo sapiens
  misc_feature (129)..(129): n is a, c, g, or t
  misc_feature (132)..(132): n is a, c, g, or t
  misc_feature (139)..(141): n is a, c, g, or t
tcccccttcacctcattaatcgagacccctatggttgtgtggttcttacccattcaagcatgtggggtttactagaacccgagcaactgaagttagattaaattgcaggggtggaaagaaatgcctttnccngaaattnnncatactttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacact

SEQ ID NO: 372853 - DNA, 905 bp, Homo sapiens
cggacgcgtgggctgatgtactaaacccagtcattttctttactcaaactccattacgagttctttcctatcaatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacact

SEQ ID NO: 372854 - DNA, 1063 bp, Homo sapiens
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggggttccgagagattgggggggaagcctttaatcggggtagggaagaatttagcggaaggcagatcttaata

SEQ ID NO: 372855 - DNA, 742 bp, Homo sapiens
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagccccgaatgccgtccccagctcccacactgttatatgatacgaccccgaccgacgcctgctcgccccagcccacgccccacaagtccacctgcacgccctcgctccagccccac

SEQ ID NO: 372856 - DNA, 553 bp, Homo sapiens
ttttctctgttcctttaaaagcaatacagccctctacttgctgcctttactactcaaggtcagtctgagctgactctgttactgaagattcaggagtattgctatgacaacattcatttcatgaaagccttccagaaaatagtggtgcttttttataaaggtaatttagattttgaattttgtaaataacacttaataaaaacccttataaacacaaaattatccaaatgatgagttatctggacatcagctccctgaaatattttacttctagttatgagtcacctctgattaaattgggtgctttttagtgcactgatacttgtttaaaacatctaaaccctattcacaagttgaagtatgaaatctaaagccatcattatgcgtcctcaaacttgcctcctatactcttaaccaggtatacattcccaaagttcagctaggtgtggtggctcatacttgtgaccccaacactttgggagcctgaggctggaggatcgcttgagcccaagagttcaagaccggcctggactgcataaggagacctcatctc

SEQ ID NO: 372857 - DNA, 405 bp, Homo sapiens
gtttttttccccttttctagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatga

SEQ ID NO: 372858 - DNA, 3369 bp, Homo sapiens
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgtttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacact

SEQ ID NO: 372859 - DNA, 3171 bp, Homo sapiens
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgtttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacact

SEQ ID NO: 372860 - DNA, 3561 bp, Homo sapiens
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgtttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacactcttaggctttataaaaaagtctttttttttttaaattccatgttaatacctagtggtattgtatgttgtgtgttcagatgtctttactgtatctgtataccattaagtaataattagactcccaaactgtaaaccacctacacagaattctggtgtagctaaaactacattaatatttctacaaccaattca

SEQ ID NO: 372861 - DNA, 3325 bp, Homo sapiens
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgtttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacact

SEQ ID NO: 372862 - DNA, 3086 bp, Homo sapiens
cggggcggaggggctgccacccaccaccgctgcggccgccgcctccgccgctgctttcgctggagggcgggcggatgtacggggcgcctggggccccggcgcaaagcgcctcagtgactgtggtccgctcgttgcggcggccgccaccgcaggcgacaggggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgtttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacact

SEQ ID NO: 372863 - DNA, 3062 bp, Homo sapiens
  misc_feature (30)..(30): n is a, c, g, or t
  misc_feature (35)..(35): n is a, c, g, or t
  misc_feature (46)..(47): n is a, c, g, or t
  misc_feature (61)..(61): n is a, c, g, or t
ccaagggtactatgaggctggaacactaanttagnaaacacccttnnggtgagtttataanacaagcagcgtacgtcgaatctggatcgcgagtgcggtacatgggattctggctcttactcttcgccttacatcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgtttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacact

SEQ ID NO: 372864 - DNA, 3302 bp, Homo sapiens
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgtttgttttgttttgttttgttttgcatttttaactccagatatcctaaagctcaattgtttggtctctggttttcatccttagagaagccatggagaacagacttgaaaagtttaggaaatcataatgtgctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacact

SEQ ID NO: 372865 - DNA, 3273 bp, Homo sapiens
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgtttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaagttgtcttaaagtcattggggatactgttatatttgaataaagggttgtacttaaaaaatttactgtgtggagggggatgtaagagacttgtaagtttgccggaagttttaatggggggtgtggggcaaatttaaagtaaaaaaaaaaggggggggtaatg

SEQ ID NO: 372866 - DNA, 2162 bp, Homo sapiens
gaagtcgacgcacctcgactctaggctcagaagactcaagacagagtcccggggatccataagatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgtttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacact

SEQ ID NO: 372867 - DNA, 1968 bp, Homo sapiens
  misc_feature (1968)..(1968): n is a, c, g, or t
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgatctgagctgagaaggtggctggattgtgaatacacctctgtaaagcaaccggagtgtgatacactgtctgtttcatgtgtctgtcttaatttcttactccggttcagctgtatagggttagggaattattaactgtcatggtggggatggggtagttcaaaccgttagggacgggtagatgacagggatattaatttacggtttaggatgtgtggtcaagatacggtaagggggggaagaatagagaatcaagaagggcaaaaatgattatgatatatan

SEQ ID NO: 372868 - DNA, 1282 bp, Homo sapiens
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcagacccgtaatagtagggggtcctctagagtcacctcagcagcag

SEQ ID NO: 372869 - DNA, 1029 bp, Homo sapiens
cttccggtgcgggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctgggtaagtgtctgtggtttgtgggcttaataatttagaaaggtataatatatggagattatggagagtctagaatatgaactatttggcaaacttgttaaaatggagtgatttttttggttttgttgtattttggttttatccaactttagccccaggtggtacactggcagatgacatgatgcgtacagatgtctgcgtgtttgcagcccaagaagatctagagaccatgcaagcatttgctcaggtaaatgaaactttacataattgttttcagttggctactatccatgtggtatatttgaggaatattctacttttaagagttgtggttagaaagttgaaggaatttgattttaaattttagggatactgttcttgg

SEQ ID NO: 372870 - DNA, 2844 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggtgactactgggcgcgggagtcctcaggacttgaagctgtcaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcaggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcact

SEQ ID NO: 372871 - DNA, 593 bp, Homo sapiens
gcagaaatggctgcaagtggccgaggtctctgcaaggctgtggccgcctctcccttcccggcgtggagacgagataacacggaagccaggggaggtctgaagcctgagtatgatgcggtggtgataggagcaggcaggcacctgggattccggtgctggctctgctgtgtggcctggggcaaatgcttgccttctctgggcttggatcttcccatggagaatgacaggaagactagagggccccaaatgcatgattgccaactgggtctatacagagataatgacgggaccgaaagcagacggcactcaacatgcagctttgagggcatgccttcattttcatatgtactagagcagttgcgagctggtagatactcaacactcacctctccagggaaaaatgtgtgatgtatgtgtgtgtgtacatgtatatatatgtatatatacacacatatatgtgtatatatatgtatatgtgttacgtacatatatatacacatatacacatgcttattttaaatattgaaataaaagatacactgcacacaattttacaaataaagatacaatactctcaatttaaaaaaaaaaaa

SEQ ID NO: 372872 - DNA, 316 bp, Homo sapiens
cagagcttggtggggagggggagggggagccaagccccactgctctctcctctggcataacccagccagaagtttatacgctagcaggggctgcaatggaaagcccttccatctggcaggcaggcacctgggattccggtgctggctctgctgtctctgggcttggatcttcccatggagaatgacaggaagactaggtgagctcaggggtttccctatatctcttgcaaagtgacctagtttccaccacattctcagcctatggtttgtaagggttggaaagagccctgggccaacagacaagtgaaatccagca

SEQ ID NO: 372873 - DNA, 5139 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccaggctttgatgtctttcaaagcttctgtggtgcgccctggattgagaaccaccacccgaggggtacagcccctctcttccaaccgagaagttcctgtccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcagatcttagcagagatgctcacatgcggggtaactgtccatggtgtgtggaggggtcctcggaaccccctcttaggatcatctccacatactctcccagttctgagattcgttaccaatagcaggtttccgtcacactgcgatatcagagcagtgcaggaactctccgctccaaggggttttttcctcctaggggaacactctgctaagtaatgggcagagaacaaaggggctcctaattcaaggcaggcctaagggagggtcagaaagaactttagctggaggtatttacagatgtgacctcgaatccttggggattcttggaaaatgggcaaggtgccaaaagaggagaactggccaggccttcaaaactaaaacaccagagaattacagacagcgaacttgcccctaagccctcgttgtgggtttgtgtttgagcatttaggagaggactccagtgctcctcagcgacagacacagctgcctctgcggtgtctgaaggccctggtcgtggtgacgctagatggccgccctgggcgcctcctgtgggcgtagaggcatcaccactctgcactggcagactcagcatggagttggagcagagtctgacacgagcacttgccatcccaggcgtttcagttctgactgagaaggtagatgcacaggggaggagagggccctttcgagctccgctctgcctccaccactcattccctaaccccgcagcctcagcgccctcacctgtaaaatggggagttttgcctacagggttcagcacaatgccagcctgacataggaacccctcgtcacaagaaactgcagtcatttcataaaggccagttaggataaaacagaactgagtcccagagttcctactgcgtgtctgcagagggagatggaccccattgccttgcagctctgggacatttggggatctgcagtgatctgccacactttgccaacccctgggctcagagtatcacagtctactgggtgctaggggaagaggcaggcccaggaccaggtggtctttccttagtgccttcctttcacacttgcagagggccccaaatgcatgattgccaactgggtctatacagagataatgacgggaccgaaagcagacggcactcaacatgcagctttgagggcatgccttcattttcatatgtactagagcagttgcgagctggtagatactcaacactcacctctccagggaaaaatgtgtgatgtatgtgtgtgtgtacatgtatatatatgtatatatacacacatatatgtgtatatatatgtatatgtgttacgtacatatatatacacatatacacatgcttattttaaatattgaaataaaagatacactgcacacaattttacaaataaagatacaatactctcaatttaaaaaaaaaaaa

SEQ ID NO: 372874 - DNA, 4767 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccaggctttgatgtctttcaaagcttctgtggtgcgccctggattgagaaccaccacccgaggggtacagcccctctcttccaaccgagaagttcctgtccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcagatcttagcagagatgctcacatgcggggtaactgtccatggtgtgtggaggggtcctcggaaccccctcttaggatcatctccacatactctcccagttctgagattcgttaccaatagcaggtttccgtcacactgcgatatcagagcagtgcaggaactctccgctccaaggggttttttcctcctaggggaacactctgctaagtaatgggcagagaacaaaggggctcctaattcaaggcaggcctaagggagggtcagaaagaactttagctggaggtatttacagatgtgacctcgaatccttggggattcttggaaaatgggcaaggtgccaaaagaggagaactggccaggccttcaaaactaaaacaccagagaattacagacagcgaacttgcccctaagccctcgttgtgggtttgtgtttgagcatttaggagaggactccagtgctcctcagcgacagacacagctgcctctgcggtgtctgaaggccctggtcgtggtgacgctagatggccgccctgggcgcctcctgtgggcgtagaggcatcaccactctgcactggcagactcagcatggagttggagcagagtctgacacgagcacttgccatcccaggcgtttcagttctgactgagaaggtagatgcacaggggaggagagggccctttcgagctccgctctgcctccaccactcattccctaaccccgcagcctcagcgccctcacctgtaaaatggggagttttgcctacagggttcagcacaatgccagcctgacataggaaccccagtggattgtcagttttgccattatcccctgcatcctggaggtgacaccgcctggttaataggcaacactcccgacggcccagcacagccccagggcagcaggaggctggcctgtggccaagaatgcatggtggagggggcctggagggggactgcagctcctcctcttcctgcttcctccctgctccaccccgtgcctagggcagcacaaaagccaatcgctagcaaactccctgcctagca

SEQ ID NO: 372875 - DNA, 4978 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccaggctttgatgtctttcaaagcttctgtggtgcgccctggattgagaaccaccacccgaggggtacagcccctctcttccaaccgagaagttcctgtccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcagatcttagcagagatgctcacatgcggggtaactgtccatggtgtgtggaggggtcctcggaaccccctcttaggatcatctccacatactctcccagttctgagattcgttaccaatagcaggtttccgtcacactgcgatatcagagcagtgcaggaactctccgctccaaggggttttttcctcctaggggaacactctgctaagtaatgggcagagaacaaaggggctcctaattcaaggcaggcctaagggagggtcagaaagaactttagctggaggtatttacagatgtgacctcgaatccttggggattcttggaaaatgggcaaggtgccaaaagaggagaactggccaggccttcaaaactaaaacaccagagaattacagacagcgaacttgcccctaagccctcgttgtgggtttgtgtttgagcatttaggagaggactccagtgctcctcagcgacagacacagctgcctctgcggtgtctgaaggccctggtcgtggtgacgctagatggccgccctgggcgcctcctgtgggcgtagaggcatcaccactctgcactggcagactcagcatggagttggagcagagtctgacacgagcacttgccatcccaggcgtttcagttctgactgagaaggtagatgcacaggggaggagagggccctttcgagctccgctctgcctccaccactcattccctaaccccgcagcctcagcgccctcacctgtaaaatggggagttttgcctacagggttcagcacaatgccagcctgacataggaacccctcgtcacaagaaactgcagtcatttcataaaggccagttaggataaaacagaactgagtcccagagttcctactgcgtgtctgcagagggagatggaccccattgccttgcagctctgggacatttggggatctgcagtgatctgccacactttgccaacccctgggctcagagtatcacagtctactgggtgctaggggaagaggcaggcccaggaccaggtggtctttccttagtgccttcctttcacacttgcagagggccccaaatgcatgattgccaactgggtctatacagagataatgacgggaccgaaagcagacggcactcaacatgcagctttgagggcatgccttcattttcatatgtactagagcagttgcgagctggtagatactcaacactcacctctccagggaaaaatgtgtgatgtatgtgtgtgtgtacatgtatatatatgtatatatacacacatatatgtgtatatatatgtatatgtgttacgtacatatatatacacatatacacatgcttattttaaatattgaaataaaagatacactgcacacaattttacaaataaagatacaatactctcaatttaaaaaaaaaaaa

SEQ ID NO: 372876 - DNA, 5059 bp, Homo sapiens
gcggtcctacccggaagcgcgcccgggctcctgcaggcggggcgctgtgcgcgccgcgatccgcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccaggctttgatgtctttcaaagcttctgtggtgcgccctggattgagaaccaccacccgaggggtacagcccctctcttccaaccgagaagttcctgtccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcagatcttagcagagatgctcacatgcggggtaactgtccatggtgtgtggaggggtcctcggaaccccctcttaggatcatctccacatactctcccagttctgagattcgttaccaatagcaggtttccgtcacactgcgatatcagagcagtgcaggaactctccgctccaaggggttttttcctcctaggggaacactctgctaagtaatgggcagagaacaaaggggctcctaattcaaggcaggcctaagggagggtcagaaagaactttagctggaggtatttacagatgtgacctcgaatccttggggattcttggaaaatgggcaaggtgccaaaagaggagaactggccaggccttcaaaactaaaacaccagagaattacagacagcgaacttgcccctaagccctcgttgtgggtttgtgtttgagcatttaggagaggactccagtgctcctcagcgacagacacagctgcctctgcggtgtctgaaggccctggtcgtggtgacgctagatggccgccctgggcgcctcctgtgggcgtagaggcatcaccactctgcactggcagactcagcatggagttggagcagagtctgacacgagcacttgccatcccaggcgtttcagttctgactgagaaggtagatgcacaggggaggagagggccctttcgagctccgctctgcctccaccactcattccctaaccccgcagcctcagcgccctcacctgtaaaatggggagttttgcctacagggttcagcacaatgccagcctgacataggaacccctcgtcacaagaaactgcagtcatttcataaaggccagttaggataaaacagaactgagtcccagagttcctactgcgtgtctgcagagggagatggaccccattgccttgcagctctgggacatttggggatctgcagtgatctgccacactttgccaacccctgggctcagagtatcacagtctactgggtgctaggggaagaggcaggcccaggaccaggtggtctttccttagtgccttcctttcacacttgcagagggccccaaatgcatgattgccaactgggtctatacagagataatgacgggaccgaaagcagacggcactcaacatgcagctttgagggcatgccttcattttcatatgtactagagcagttgcgagctggtagatactcaacactcacctctccagggaaaaatgtgtgatgtatgtgtgtgtgtacatgtatatatatgtatatatacacacatatatgtgtatatatatgtatatgtgttacgtacatatatatacacatatacacatgcttattttaaatattgaaataaaagatacactgcacacaattttacaaataaagatacaatactctcaatttaaaaaaaaaaaa

SEQ ID NO: 372877 - DNA, 4617 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtgggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcagatcttagcagagatgctcacatgcggggtaactgtccatggtgtgtggaggggtcctcggaaccccctcttaggatcatctccacatactctcccagttctgagattcgttaccaatagcaggtttccgtcacactgcgatatcagagcagtgcaggaactctccgctccaaggggttttttcctcctaggggaacactctgctaagtaatgggcagagaacaaaggggctcctaattcaaggcaggcctaagggagggtcagaaagaactttagctggaggtatttacagatgtgacctcgaatccttggggattcttggaaaatgggcaaggtgccaaaagaggagaactggccaggccttcaaaactaaaacaccagagaattacagacagcgaacttgcccctaagccctcgttgtgggtttgtgtttgagcatttaggagaggactccagtgctcctcagcgacagacacagctgcctctgcggtgtctgaaggccctggtcgtggtgacgctagatggccgccctgggcgcctcctgtgggcgtagaggcatcaccactctgcactggcagactcagcatggagttggagcagagtctgacacgagcacttgccatcccaggcgtttcagttctgactgagaaggtagatgcacaggggaggagagggccctttcgagctccgctctgcctccaccactcattccctaaccccgcagcctcagcgccctcacctgtaaaatggggagttttgcctacagggttcagcacaatgccagcctgacataggaacccctcgtcacaagaaactgcagtcatttcataaaggccagttaggataaaacagaactgagtcccagagttcctactgcgtgtctgcagagggagatggaccccattgccttgcagctctgggacatttggggatctgcagtgatctgccacactttgccaacccctgggctcagagtatcacagtctactgggtgctaggggaagaggcaggcccaggaccaggtggtctttccttagtgccttcctttcacacttgcagagggccccaaatgcatgattgccaactgggtctatacagagataatgacgggaccgaaagcagacggcactcaacatgcagctttgagggcatgccttcattttcatatgtactagagcagttgcgagctggtagatactcaacactcacctctccagggaaaaatgtgtgatgtatgtgtgtgtgtacatgtatatatatgtatatatacacacatatatgtgtatatatatgtatatgtgttacgtacatatatatacacatatacacatgcttattttaaatattgaaataaaagatacactgcacacaattttacaaataaagatacaatactctcaatttaaaaaaaaaaaa

SEQ ID NO: 372878 - DNA, 3396 bp, Homo sapiens
  misc_feature (2974)..(2974): n is a, c, g, or t
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactaaaaaaaaaaaaaaaaaaaaaaaaaaaaaaaaaaaaaaaaaaaaaaaaaaaaaaaaaaaaaaaaaaaaaaaaanaaaaaaaaaaaaaagagaggggcggcggcgaacatagtaatcacacgcagccgagggaggcgccccagaagcagagcagacgccgcacagttttgtggtagagcagagggaggggccaccaatagaggaggaggtcgtctgtcatatatctataacctccacgcacgcgaccggcggcggccgcgcgcgagctacaccaacaccagagcaggacagcgaccgcagaggaaccacaccgacaatcagagccggaggagcactatcgtgggacaaacaagcaacccgacaccaccggcgcggggggggggaagacacaatcaagagaggaacaaaaccacccaccaccgagcggagaaagcaagaagccacaccccgcaggggagacacacccacaaacgaccaaagagacgcaccgtaacaaa

SEQ ID NO: 372879 - DNA, 3643 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggagaggactccagtgctcctcagcgacagacacagctgcctctgcggtgtctgaaggccctggtcgtggtgacgctagatggccgccctgggcgcctcctgtgggcgtagaggcatcaccactctgcactggcagactcagcatggagttggagcagagtctgacacgagcacttgccatcccaggcgtttcagttctgactgagaaggtagatgcacaggggaggagagggccctttcgagctccgctctgcctccaccactcattccctaaccccgcagcctcagcgccctcacctgtaaaatggggagttttgcctacagggttcagcacaatgccagcctgacataggaacccctcgtcacaagaaactgcagtcatttcataaaggccagttaggataaaacagaactgagtcccagagttcctactgcgtgtctgcagagggagatggaccccattgccttgcagctctgggacatttggggatctgcagtgatctgccacactttgccaacccctgggctcagagtatcacagtctactgggtgctaggggaagaggcaggcccaggaccaggtggtctttccttagtgccttcctttcacacttgcagagggccccaaatgcatgattgccaactgggtctatacagagataatgacgggaccgaaagcagacggcactcaacatgcagctttgagggcatgccttcattttcatatgtactagagcagttgcgagctggtagatactcaacactcacctctccagggaaaaatgtgtgatgtatgtgtgtgtgtacatgtatatatatgtatatatacacacatatatgtgtatatatatgtatatgtgttacgtacatatatatacacatatacacatgcttattttaaatattgaaataaaagatacactgcacacaattttacaaataaagatacaatactctcaatttaaaaaaaaaaaa

SEQ ID NO: 372880 - DNA, 1843 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggtgactactgggcgcgggagtcctcaggacttgaagctgtcagccacagtgccagctccctgcgcccggccgacctgcttgccctcatcctcctggttcaggacctctaccccagcgagagcacagcagaggacgacattcaggagacagacagcttctccctccctgaggagtacttcacaccagctccttcccctggcgatcagagctcaggtgaggaccggaggaaagcaggaggaaacaatagctagctgcgagcgacaggcagcccaggacatctgtcttaggctccagtggacccccgtgcctcctaaggcttgagtgcaggtacccgtgttcctagagcacaggacgctgtctgcggctccccatcttccctgccagctccagcctgaactcaaggactgttaagaccactccactgatccctaaagctgttgatgacaagttgattcatttaaaacttctgtacatgcattctcagactcatcttttttgtaattaaaattaaaaattaagttaaatttagtaataatcatctaatttctatacattctaaaatatattcagcatctgtagtttatactttgtttctccaaagtatgtgggtaaacaataaaaaaaaactataaatattcaaaatggttgaggtgtggtcgtcacgcctgtaatcccagcactttgggaggccgaggcgggtagatcacctgaggtcaggagtttgagactagcctggccaacatggcgaaaccccatgtctactaaaaatacaaaaattagccaggtctggtggcaggcgcctgtaatcccagctactcgggaggctgaggcaggagaatcgcttgaacccgggaggtggaggttgcagtgagccaagatcatgccactgcactccagcctgggcgacagagcaagactctgtctcaaaaaaaaaaaacaaaacaaaactacaaatattcaaaatgttaacaaaaaatggacaaccttgcttagagaagtagataaaccaaaatccagactgttgtggtcactatgaataaacattacatttatttctgaagttcttaggtaaaaaaaaa

SEQ ID NO: 372881 - DNA, 1285 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggtgactactgggcgcgggagtcctcaggacttgaagctgtcaggtcagagggggcgtccacctttaagaccatgttttaaccctaatgaatgaaggcacaagcagcccctgaaactcgtgtattcagagagagttgttctttctggccatatggagggttgggtaccctgatgggctttcccatggtaaaacagctcgatcctggataacacatacttttaatgcaatttttgggttcactgtaaattacaggaatctttgaagacagttccttcaaccctcccctccttttcccacaaaattatattgagctggaactggaggggaaagcagtggagaaaaacacagcgctaaaggcaagattccctgagtgcaaatgataccagcactacagccagtaaatagccttaggccagcagcagcataggagagctgagcctgcaactctaggttaagcccagccccaaaaagttaaagtggctactggtccttttataaagccctagtaaataaaaaaaaaa

SEQ ID NO: 372882 - DNA, 1436 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagaggttggcctcttgatgctctgagctcggtgaccccacccccacaccccaccagtcctctctggactaaatgagggcaagaagaagtcgaattttatcacgtaacagaagaacttggagccatcagtttctgtaacctaaaaagtttaacaaggctgggcgcggtggctcacgcctgtaatcacaacactttgggaagccaaggtgggccagttgcttgagctcagggatttgagaccagcctgggcagcatggcgaaaccctgtctctacaaaaaaaatacaaaaattagccaggtgtggtggtgcgtgcctatagtcccagctacttgggaggttgaggtgggaggatcacttgagtccaggtggtagaggctgcagtgagccgagactgtgcccatgcattccaacctgggcgacagagcaaaaaaaaaaaaaaaaagtttaacgtaagctgaacacgttaattttttaatagctgtattaaggtatgattaacataccataaattgcacatatttaaagtgcataatttgataagctttgatatgtatatacctatgattctatcacaatcaataaaaggaatatatctaccacctcaaacatttgtaatcccttctttcccatccccatcgcataggaactgctgatctgctttctgtcatgatagattagtttgtatcatatggccttatataaatggagtcatacagtatgtgcttggatttagtttggttttggtttgactgctttcactcagcataattattttgtgattcatctgtgttgtggcatgtatcaatcgttcattccttgtcattgagtagtaatctattgtatcaggatgccaccatttgttcattcatttacttgttgatggacatctgtgttattttcagtttttgactattacaaataaagcaactatgaacatgcacgtacaagtctatgtatacatggatgctttcatgtccaaggacagatacttaggatagactggctaggtcatgtaggtgtatgtgtaactttttaataaactgccaaacttttccaaagtggttgt

SEQ ID NO: 372883 - DNA, 1596 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgaggtagggtccctaggggtcccggagcgggcccactcctagcctcacccactccgggcgtgtggccgtgggccggtcgcttcctcgctcggggccaaagttcctcagccgtgaagaggggtggatgtcacaagtcaagcctccttcccagggtggccgtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagaggttggcctcttgatgctctgagctcggtgaccccacccccacaccccaccagtcctctctggactaaatgagggcaagaagaagtcgaattttatcacgtaacagaagaacttggagccatcagtttctgtaacctaaaaagtttaacaaggctgggcgcggtggctcacgcctgtaatcacaacactttgggaagccaaggtgggccagttgcttgagctcagggatttgagaccagcctgggcagcatggcgaaaccctgtctctacaaaaaaaatacaaaaattagccaggtgtggtggtgcgtgcctatagtcccagctacttgggaggttgaggtgggaggatcacttgagtccaggtggtagaggctgcagtgagccgagactgtgcccatgcattccaacctgggcgacagagcaaaaaaaaaaaaaaaaagtttaacgtaagctgaacacgttaattttttaatagctgtattaaggtatgattaacataccataaattgcacatatttaaagtgcataatttgataagctttgatatgtatatacctatgattctatcacaatcaataaaaggaatatatctaccacctcaaacatttgtaatcccttctttcccatccccatcgcataggaactgctgatctgctttctgtcatgatagattagtttgtatcatatggccttatataaatggagtcatacagtatgtgcttggatttagtttggttttggtttgactgctttcactcagcataattattttgtgattcatctgtgttgtggcatgtatcaatcgttcattccttgtcattgagtagtaatctattgtatcaggatgccaccatttgttcattcatttacttgttgatggacatctgtgttattttcagtttttgactattacaaataaagcaactatgaacatgcacgtacaagtctatgtatacatggatgctttcatgtccaaggacagatacttaggatagactggctaggtcatgtaggtgtatgtgtaactttttaataaactgccaaacttttccaaagtggttgt

SEQ ID NO: 372884 - DNA, 340 bp, Homo sapiens
aagaggggtggatgtcacaagtcaagcctccttcccagggtggccgtgaggttcgggggtggggggaggtggggatttggggtgaaactggacagaaactggcgtgctaggcaaacgggagccccgcggcggcgaactgctgactcgctctctccagagactcaggggcagggccgggctccgaaggtgtgggaccccagaaggagctgctgaagacgggaccaagggccacagggaggtttgctggggtccagatggtgaaagtgggcgctgggggtcgccccaggttggccccccgccatctggagctcctttcgtcagtgagtcccctccgagttcc

SEQ ID NO: 372885 - DNA, 2060 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtgaggaccggaggaaagcaggaggaaacaatagctagctgcgagcgacaggcagcccaggacatctgtcttaggctccagtggacccccgtgcctcctaaggcttgagtgcaggtacccgtgttcctagagcacaggacgctgtctgcggctccccatcttccctgccagctccagcctgaactcaaggactgttaagaccactccactgatccctaaagctgttgatgacaagttgattcatttaaaacttctgtacatgcattctcagactcatcttttttgtaattaaaattaaaaattaagttaaatttagtaataatcatctaatttctatacattctaaaatatattcagcatctgtagtttatactttgtttctccaaagtatgtgggtaaacaataaaaaaaaactataaatattcaaaatggttgaggtgtggtcgtcacgcctgtaatcccagcactttgggaggccgaggcgggtagatcacctgaggtcaggagtttgagactagcctggccaacatggcgaaaccccatgtctactaaaaatacaaaaattagccaggtctggtggcaggcgcctgtaatcccagctactcgggaggctgaggcaggagaatcgcttgaacccgggaggtggaggttgcagtgagccaagatcatgccactgcactccagcctgggcgacagagcaagactctgtctcaaaaaaaaaaaacaaaacaaaactacaaatattcaaaatgttaacaaaaaatggacaaccttgcttagagaagtagataaaccaaaatccagactgttgtggtcactatgaataaacattacatttatttctgaagttcttaggtaaaaaaaaa

SEQ ID NO: 372886 - DNA, 766 bp, Homo sapiens
gcggtcctacccggaagcgcgcccgggctcctgcaggcggggcgctgtgcgcgccgcgatccgcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagtgagtcttcaaagctggtcccctctgtcctttgccgagcaccctcgctgggccaggcagcgtgtgcccagcccctgtgaagctgccatttttcacatactgcccccagctgggtccctaggtcagagaaacagctcaagtgaaccttggagaccatctggtctgaccctctgactttatatctggtgaaa

SEQ ID NO: 372887 - DNA, 490 bp, Homo sapiens
gcagaaatggctgcaagtggccgaggtctctgcaaggctgtggccgcctctcccttcccggcgtggagacgagataacacggaagccaggggaggtctgaagcctgagtatgatgcggtggtgataggagcagagggccccaaatgcatgattgccaactgggtctatacagagataatgacgggaccgaaagcagacggcactcaacatgcagctttgagggcatgccttcattttcatatgtactagagcagttgcgagctggtagatactcaacactcacctctccagggaaaaatgtgtgatgtatgtgtgtgtgtacatgtatatatatgtatatatacacacatatatgtgtatatatatgtatatgtgttacgtacatatatatacacatatacacatgcttattttaaatattgaaataaaagatacactgcacacaattttacaaataaagatacaatactctcaatttaaaaaaaaaaaa

SEQ ID NO: 372888 - DNA, 3710 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccaggctttgatgtctttcaaagcttctgtggtgcgccctggattgagaaccaccacccgaggggtacagcccctctcttccaaccgagaagttcctgtccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtga

SEQ ID NO: 372889 - DNA, 4779 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctggctgcggcccccagacctggcgcagcgtgtccagctgtgggagcacttccagagcctgctgtggacctacagccgcctgcgggagcaggagcagtgcttcgccgtggaggtgactactgggcgcgggagtcctcaggacttgaagctgtcagccacagtgccagctccctgcgcccggccgacctgcttgccctcatcctcctggttcaggacctctaccccagcgagagcacagcagaggacgacattcaggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccaggctttgatgtctttcaaagcttctgtggtgcgccctggattgagaaccaccacccgaggggtacagcccctctcttccaaccgagaagttcctgtccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcagatcttagcagagatgctcacatgcggggtaactgtccatggtgtgtggaggggtcctcggaaccccctcttaggatcatctccacatactctcccagttctgagattcgttaccaatagcaggtttccgtcacactgcgatatcagagcagtgcaggaactctccgctccaaggggttttttcctcctaggggaacactctgctaagtaatgggcagagaacaaaggggctcctaattcaaggcaggcctaagggagggtcagaaagaactttagctggaggtatttacagatgtgacctcgaatccttggggattcttggaaaatgggcaaggtgccaaaagaggagaactggccaggccttcaaaactaaaacaccagagaattacagacagcgaacttgcccctaagccctcgttgtgggtttgtgtttgagcatttaggagaggactccagtgctcctcagcgacagacacagctgcctctgcggtgtctgaaggccctggtcgtggtgacgctagatggccgccctgggcgcctcctgtgggcgtagaggcatcaccactctgcactggcagactcagcatggagttggagcagagtctgacacgagcacttgccatcccaggcgtttcagttctgactgagaaggtagatgcacaggggaggagagggccctttcgagctccgctctgcctccaccactcattccctaaccccgcagcctcagcgccctcacctgtaaaatggggagttttgcctacagggttcagcacaatgccagcctgacataggaacccctcgtcacaagaaactgcagtcatttcataaaggccagttaggataaaacagaactgagtcccagagttcctactgcgtgtctgcagagggagatggaccccattgccttgcagctctgggacatttggggatctgcagtgatctgccacactttgccaacccctgggctcagagtatcacagtctactgggtgctaggggaagaggcaggcccaggaccaggtggtctttccttagtgccttcctttcacacttgcagagggccccaaatgcatgattgccaactgggtctatacagagataatgacgggaccgaaagcagacggcactcaacatgcagctttgagggcatgccttcattttcatatgtactagagcagttgcgagctggtagatactcaacactcacctctccagggaaaaatgtgtgatgtatgtgtgtgtgtacatgtatatatatgtatatatacacacatatatgtgtatatatatgtatatgtgttacgtacatatatatacacatatacacatgcttattttaaatattgaaataaaagatacactgcacacaattttacaaataaagatacaatactctcaatttaaaaaaaaaaaa

SEQ ID NO: 372890 - DNA, 4718 bp, Homo sapiens
cccgttccccaccaaagctgtggacacaagaagccctgagagacggtgcacgggtcagccagtcttgcgaattcggtccaacacaaggtcaaggatctccttgccaatggtgtagtgccctcgggcatagttatgggcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccaggctttgatgtctttcaaagcttctgtggtgcgccctggattgagaaccaccacccgaggggtacagcccctctcttccaaccgagaagttcctgtccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcagatcttagcagagatgctcacatgcggggtaactgtccatggtgtgtggaggggtcctcggaaccccctcttaggatcatctccacatactctcccagttctgagattcgttaccaatagcaggtttccgtcacactgcgatatcagagcagtgcaggaactctccgctccaaggggttttttcctcctaggggaacactctgctaagtaatgggcagagaacaaaggggctcctaattcaaggcaggcctaagggagggtcagaaagaactttagctggaggtatttacagatgtgacctcgaatccttggggattcttggaaaatgggcaaggtgccaaaagaggagaactggccaggccttcaaaactaaaacaccagagaattacagacagcgaacttgcccctaagccctcgttgtgggtttgtgtttgagcatttaggagaggactccagtgctcctcagcgacagacacagctgcctctgcggtgtctgaaggccctggtcgtggtgacgctagatggccgccctgggcgcctcctgtgggcgtagaggcatcaccactctgcactggcagactcagcatggagttggagcagagtctgacacgagcacttgccatcccaggcgtttcagttctgactgagaaggtagatgcacaggggaggagagggccctttcgagctccgctctgcctccaccactcattccctaaccccgcagcctcagcgccctcacctgtaaaatggggagttttgcctacagggttcagcacaatgccagcctgacataggaacccctcgtcacaagaaactgcagtcatttcataaaggccagttaggataaaacagaactgagtcccagagttcctactgcgtgtctgcagagggagatggaccccattgccttgcagctctgggacatttggggatctgcagtgatctgccacactttgccaacccctgggctcagagtatcacagtctactgggtgctaggggaagaggcaggcccaggaccaggtggtctttccttagtgccttcctttcacacttgcagagggccccaaatgcatgattgccaactgggtctatacagagataatgacgggaccgaaagcagacggcactcaacatgcagctttgagggcatgccttcattttcatatgtactagagcagttgcgagctggtagatactcaacactcacctctccagggaaaaatgtgtgatgtatgtgtgtgtgtacatgtatatatatgtatatatacacacatatatgtgtatatatatgtatatgtgttacgtacatatatatacacatatacacatgcttattttaaatattgaaataaaagatacactgcacacaattttacaaataaagatacaatactctcaatttaaaaaaaaaaaa

SEQ ID NO: 372891 - DNA, 4526 bp, Homo sapiens
atcacatgcatatgttatttatctagcaaatccccaggaaaatcgcgtcatgtgtccagtgtttgctgttaggtatgacactgaagaggaatttttgtggcatctctcatgatttccttaattctataattttttgcactaaaggctttcttgcttagatccctctgtaaggctggagccttgcccatttggtcactttatgcctcagtttccccaatttgagtggctgttgggatgttctgagggtgattgaaatgatacaatgttgaacattagatacctccatctgttgcaaatgtggggaggggacctctccccgtccactccccatccacgagtgtttccctgccttctcggtcctctgtgccaccacccagcccctctgcccctgcccactgccctgcttggcacccgggccagactctgggcagaaaggcccaggagcagctgagggagaggggcaacagcgaaactggagctgcgagggcaggttcagcagagtgcaggaatttaaaaactggagtttcttggagctaaaaatgattatttcttgtggttcacagatagggccgcaatgggtgggtccaacttagggatcccacctctcactgcagctcttcttcctctgtagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccaggctttgatgtctttcaaagcttctgtggtgcgccctggattgagaaccaccacccgaggggtacagcccctctcttccaaccgagaagttcctgtccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcagatcttagcagagatgctcacatgcggggtaactgtccatggtgtgtggaggggtcctcggaaccccctcttaggatcatctccacatactctcccagttctgagattcgttaccaatagcaggtttccgtcacactgcgatatcagagcagtgcaggaactctccgctccaaggggttttttcctcctaggggaacactctgctaagtaatgggcagagaacaaaggggctcctaattcaaggcaggcctaagggagggtcagaaagaactttagctggaggtatttacagatgtgacctcgaatccttggggattcttggaaaatgggcaaggtgccaaaagaggagaactggccaggccttcaaaactaaaacaccagagaattacagacagcgaacttgcccctaagccctcgttgtgggtttgtgtttgagcatttaggagaggactccagtgctcctcagcgacagacacagctgcctctgcggtgtctgaaggccctggtcgtggtgacgctagatggccgccctgggcgcctcctgtgggcgtagaggcatcaccactctgcactggcagactcagcatggagttggagcagagtctgacacgagcacttgccatcccaggcgtttcagttctgactgagaaggtagatgcacaggggaggagagggccctttcgagctccgctctgcctccaccactcattccctaaccccgcagcctcagcgccctcacctgtaaaatggggagttttgcctacagggttcagcacaatgccagcctgacataggaacccctcgtcacaagaaactgcagtcatttcataaaggccagttaggataaaacagaactgagtcccagagttcctactgcgtgtctgcagagggagatggaccccattgccttgcagctctgggacatttggggatctgcagtgatctgccacactttgccaacccctgggctcagagtatcacagtctactgggtgctaggggaagaggcaggcccaggaccaggtggtctttccttagtgccttcctttcacacttgcagagggccccaaatgcatgattgccaactgggtctatacagagataatgacgggaccgaaagcagacggcactcaacatgcagctttgagggcatgccttcattttcatatgtactagagcagttgcgagctggtagatactcaacactcacctctccagggaaaaatgtgtgatgtatgtgtgtgtgtacatgtatatatatgtatatatacacacatatatgtgtatatatatgtatatgtgttacgtacatatatatacacatatacacatgcttattttaaatattgaaataaaagatacactgcacacaattttacaaataaagatacaatactctcaatttaaaaaaaaaaaa

SEQ ID NO: 372892 - DNA, 3528 bp, Homo sapiens
  misc_feature (2974)..(2974): n is a, c, g, or t
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactaaaaaaaaaaaaaaaaaaaaaaaaaaaaaaaaaaaaaaaaaaaaaaaaaaaaaaaaaaaaaaaaaaaaaaaaanaaaaaaaaaaaaaagagagggcgcgcgcgcgcgccccatatattccccccccggggcgccccccctcagccagcgcccccccattttatttattaatcaaagaggaggcgctcccgctcctcttgttgagagtgagttcttttactataaacaacgagcgagagcgcgcggcgcggcacggcttgatttaataacacatgagcgtgatggatgagcgaagaacaagagtgacctagcagtatgcaaacttctggtgaaaaaaagaagacccctctcattttgttggggtgcgcgtgggcgagcacataatcagctgttgagggaggcacaactacctcctccgccaacgcgagatagataaatagaccgtcgcgctctcgtaggagaggatataatatataaaacatatttctaagagacgagtgtacatcagcgcgcgtgtgaacacaacacgtactctataaattggccgtgcgctgcggaacacaacagtttgtgtgacgaagggaggtatatatcgtagtagaaaaacttatatttatacacgaggaggg

SEQ ID NO: 372893 - DNA, 4945 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccaggctttgatgtctttcaaagcttctgtggtgcgccctggattgagaaccaccacccgaggggtacagcccctctcttccaaccgagaagttcctgtccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcagatcttagcagagatgctcacatgcggggtaactgtccatggtgtgtggaggggtcctcggaaccccctcttaggatcatctccacatactctcccagttctgagattcgttaccaatagcaggtttccgtcacactgcgatatcagagcagtgcaggaactctccgctccaaggggttttttcctcctaggggaacactctgctaagtaatgggcagagaacaaaggggctcctaattcaaggcaggcctaagggagggtcagaaagaactttagctggaggtatttacagatgtgacctcgaatccttggggattcttggaaaatgggcaaggtgccaaaagaggagaactggccaggccttcaaaactaaaacaccagagaattacagacagcgaacttgcccctaagccctcgttgtgggtttgtgtttgagcatttaggagaggactccagtgctcctcagcgacagacacagctgcctctgcggtgtctgaaggccctggtcgtggtgacgctagatggccgccctgggcgcctcctgtgggcgtagaggcatcaccactctgcactggcagactcagcatggagttggagcagagtctgacacgagcacttgccatcccaggcgtttcagttctgactgagaaggtagatgcacaggggaggagagggccctttcgagctccgctctgcctccaccactcattccctaaccccgcagcctcagcgccctcacctgtaaaatggggagttttgcctacagggttcagcacaatgccagcctgacataggaacccctcgtcacaagaaactgcagtcatttcataaaggccagttaggataaaacagaactgagtcccagagttcctactgcgtgtctgcagagggagatggaccccattgccttgcagctctgggacatttggggatctgcagtgatctgccacactttgccaacccctgggctcagagtatcacagtctactgggtgctaggggaagaggcaggcccaggaccaggtggtctttccttagtgccttcctttcacacttgcagagggccccaaatgcatgattgccaactgggtctatacagagataatgacgggaccgaaagcagacggcactcaacatgcagctttgagggcatgccttcattttcatatgtactagagcagttgcgagctggtagatactcaacactcacctctccagggaaaaatgtgtgatgtatgtgtgtgtgtacatgtatatatatgtatatatacacacatatatgtgtatatatatgtatatgtgttacgtacatatatatacacatatacacatgcttattttaaatattgaaataaaagatacactgcacacaattttacaaataaagatacaatactctcaatttaaaaaaaaaaaa

SEQ ID NO: 372894 - DNA, 2208 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggtgtgtgctgtgcacttcgtggagtcaggggcaggaggggatcggcctctgcaggcgaccaggcctttcccatccctcctgggagagcagggacagggttgagccagctgggagagcctctcaacctgagccaccttctccattccaggagacagacagcttctccctccctgaggagtacttcacaccagctccttcccctggcgatcagagctcaggtgaggaccggaggaaagcaggaggaaacaatagctagctgcgagcgacaggcagcccaggacatctgtcttaggctccagtggacccccgtgcctcctaaggcttgagtgcaggtacccgtgttcctagagcacaggacgctgtctgcggctccccatcttccctgccagctccagcctgaactcaaggactgttaagaccactccactgatccctaaagctgttgatgacaagttgattcatttaaaacttctgtacatgcattctcagactcatcttttttgtaattaaaattaaaaattaagttaaatttagtaataatcatctaatttctatacattctaaaatatattcagcatctgtagtttatactttgtttctccaaagtatgtgggtaaacaataaaaaaaaactataaatattcaaaatggttgaggtgtggtcgtcacgcctgtaatcccagcactttgggaggccgaggcgggtagatcacctgaggtcaggagtttgagactagcctggccaacatggcgaaaccccatgtctactaaaaatacaaaaattagccaggtctggtggcaggcgcctgtaatcccagctactcgggaggctgaggcaggagaatcgcttgaacccgggaggtggaggttgcagtgagccaagatcatgccactgcactccagcctgggcgacagagcaagactctgtctcaaaaaaaaaaaacaaaacaaaactacaaatattcaaaatgttaacaaaaaatggacaaccttgcttagagaagtagataaaccaaaatccagactgttgtggtcactatgaataaacattacatttatttctgaagttcttaggtaaaaaaaaa

SEQ ID NO: 372895 - DNA, 1375 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcaggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccagggtaggagagcccctcaccctgccctgatgatgcttagggttggcacgtcttgcgggtagccg

SEQ ID NO: 372896 - DNA, 1700 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctggctgcggcccccagacctggcgcagcgtgtccagctgtgggagcacttccagagcctgctgtggacctacagccgcctgcgggagcaggagcagtgcttcgccgtggaggtgactactgggcgcgggagtcctcaggacttgaagctgtcagccacagtgccagctccctgcgcccggccgacctgcttgccctcatcctcctggttcaggacctctaccccagcgagagcacagcagaggacgacattcaggagacagacagcttctccctccctgaggagtacttcacaccagctccttcccctggcgatcagagctcaggtgaggaccggaggaaagcaggaggaaacaatagctagctgcgagcgacaggcagcccaggacatctgtcttaggctccagtggacccccgtgcctcctaaggcttgagtgcaggtacccgtgttcctagagcacaggacgctgtctgcggctccccatcttccctgccagctccagcctgaactcaaggactgttaagaccactccactgatccctaaagctgttgatgacaagttgattcatttaaaacttctgtacatgcattctcagactcatcttttttgtaattaaaattaaaaattaagttaaatttagtaataatcatctaatttctatacattctaaaatatattcagcatctgtagtttatactttgtttctccaaagtatgtgggtaaacaataaaaaaaaactataaatattcaaaatggttgaggtgtggtcgtcacgcctgtaatcccagcactttgggaggccgaggcgggtagatcacctgaggtcaggagtttgagactagcctggccaacatggcgaaaccccatgtctactaaaaatacaaaaattagccaggtctggtggcaggcgcctgtaatcccagctactcgggaggctgaggcaggagaatcgcttgaacccgggaggtggaggttgcagtgagccaagatcatgccactgcactccagcctgggcgacagagcaagactctgtctcaaaaaaaaaaaacaaaacaaaactacaaatattcaaaatgttaacaaaaaatggacaaccttgcttagagaagtagataaaccaaaatccagactgttgtggtcactatgaataaacattacatttatttctgaagttcttaggtaaaaaaaaa

SEQ ID NO: 372897 - DNA, 1602 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagaggtgagtgcagggtaggcagtcccaggaggggtggataggaaggaaccatacaaaactcccagcaggcagagaggcaggaaaacctgtgttcaccctgtcctgggcagcatgagcagggtgctgggtggggtccagcatccttcacacctagacccttatcctcaaggttggcctcttgatgctctgagctcggtgaccccacccccacaccccaccagtcctctctggactaaatgagggcaagaagaagtcgaattttatcacgtaacagaagaacttggagccatcagtttctgtaacctaaaaagtttaacaaggctgggcgcggtggctcacgcctgtaatcacaacactttgggaagccaaggtgggccagttgcttgagctcagggatttgagaccagcctgggcagcatggcgaaaccctgtctctacaaaaaaaatacaaaaattagccaggtgtggtggtgcgtgcctatagtcccagctacttgggaggttgaggtgggaggatcacttgagtccaggtggtagaggctgcagtgagccgagactgtgcccatgcattccaacctgggcgacagagcaaaaaaaaaaaaaaaaagtttaacgtaagctgaacacgttaattttttaatagctgtattaaggtatgattaacataccataaattgcacatatttaaagtgcataatttgataagctttgatatgtatatacctatgattctatcacaatcaataaaaggaatatatctaccacctcaaacatttgtaatcccttctttcccatccccatcgcataggaactgctgatctgctttctgtcatgatagattagtttgtatcatatggccttatataaatggagtcatacagtatgtgcttggatttagtttggttttggtttgactgctttcactcagcataattattttgtgattcatctgtgttgtggcatgtatcaatcgttcattccttgtcattgagtagtaatctattgtatcaggatgccaccatttgttcattcatttacttgttgatggacatctgtgttattttcagtttttgactattacaaataaagcaactatgaacatgcacgtacaagtctatgtatacatggatgctttcatgtccaaggacagatacttaggatagactggctaggtcatgtaggtgtatgtgtaactttttaataaactgccaaacttttccaaagtggttgt

SEQ ID NO: 372898 - DNA, 1686 bp, Homo sapiens
gcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagaggttggcctcttgatgctctgagctcggtgaccccacccccacaccccaccagtcctctctggactaaatgagggcaagaagaagtcgaattttatcacgtaacagaagaacttggagccatcagtttctgtaacctaaaaagtttaacaaggctgggcgcggtggctcacgcctgtaatcacaacactttgggaagccaaggtgggccagttgcttgagctcagggatttgagaccagcctgggcagcatggcgaaaccctgtctctacaaaaaaaatacaaaaattagccaggtgtggtggtgcgtgcctatagtcccagctacttgggaggttgaggtgggaggatcacttgagtccaggtggtagaggctgcagtgagccgagactgtgcccatgcattccaacctgggcgacagagcaaaaaaaaaaaaaaaaagtttaacgtaagctgaacacgttaattttttaatagctgtattaaggtatgattaacataccataaattgcacatatttaaagtgcataatttgataagctttgatatgtatatacctatgattctatcacaatcaataaaaggaatatatctaccacctcaaacatttgtaatcccttctttcccatccccatcgcataggaactgctgatctgctttctgtcatgatagattagtttgtatcatatggccttatataaatggagtcatacagtatgtgcttggatttagtttggttttggtttgactgctttcactcagcataattattttgtgattcatctgtgttgtggcatgtatcaatcgttcattccttgtcattgagtagtaatctattgtatcaggatgccaccatttgttcattcatttacttgttgatggacatctgtgttattttcagtttttgactattacaaataaagcaactatgaacatgccaagaaaaaaaaaaaaaaagcaaacaaaagcacaaagaaaacaggagagacgaacaagaaaagaggcacgcagacgaacagccggacaagaaggggaacgaggagagggcgacgagcaaggaggcacgaggcacgcgcgacggaacgcgggcgggacagggaggacaacgcgaaagagggagcggaggggaaagagagaggggagagacgagagaaccaagagagaggggagaagaggagcacgggatacaggggaagagagaggcagagaaagaggcgagaggacgagaagagagtaaagaaaggagacggaaaaaagcgagaaagagataggcaggaccgcaggagagggagaagaaagaagggagagaaaagaa

SEQ ID NO: 372899 - DNA, 2327 bp, Homo sapiens
  misc_feature (3)..(3): n is a, c, g, or t
  misc_feature (5)..(5): n is a, c, g, or t
  misc_feature (7)..(7): n is a, c, g, or t
ggngngnggggagcttgcggcacagctagggcatcccggcgaggagcgccgccaggccccgggccacagccgggcctggcggggggaccatgggcgcctcggtctccaggggccgggccgcccgggtccccgcgccggagccggaacccgaagaggcgctggacctgagccaactacccccagagctgcttctggtggtgctgagccacgtccccccgcgcacgctgctcgggcgctgccgccaagtgtgccggggctggcgagccctggtggacggccaggccctgtggctgctgatcctggcccgcgaccacggcgccaccggccgcgcgctgctgcacctcgcccgcagctgccagtctcccgcccgtaacgccaggccttgccccctgggccgcttctgcgcgcgcagacccatcggacgcaaccttattcgcaacccctgcggccaagaaggcctccgaaagtggatggtgcaacacggtggggacggctgggtggtggaggaaaacaggacaaccgtgcctggggccccttctcagacgtgcttcgtgacttcattcagctggtgttgcaagaagcaggtcttggacctagaggaggagggtctgtggccagaactgctggatagtggcaggattgagatttgtgtctctgactggtggggagcccgacacgacagcggctgtatgtacagactcctcgtccaacttctagacgccaaccagactgttctagataaattctctgctgtgcctgatcccatcccgcagtggaacaacaatgcctgccttcacgtcacccacgtgttctccaacatcaagatgggcgtccgctttgtgtctttcgaacaccggggccaggacacacagttctgggctggccactatggagcccgtgtgaccaactccagtgtgatcgtgcgagtccgtctgtcctagtccagcactacccttcttgcaagacagcctgactgtgccttccagggcctgggaccattggctgggacccctcattaaccaaccaagcacttgtacctccctggcatactgggaattcctgggtccaatcaaaggccctgacgggccctgtcttcaggttctagaaactaccagaagaagcttcttccatcttatctacctactgcagctgctgctttgcgggggggccctactgtactgaggggaaacccacaagtgagcatgggggaatgcccatcctggagaagaattcttgccctcccctctcttctcctcccaaccaaaaccctccgatccagccccaggcccctctgtaccatcccctcccctccgcaccactgacctcttgtctcctattgtttctgccacagggacttccttggtcccttcagggaagccctcaactcatctctgaacttagaatctcatccttagggctcagagagtcccagccctaagggtgtgaacctcacctcctggggcttccgagctacagggctgggaccaggtcatgcagctgaaagtctacgttaaaaaaaaaaagtttgggccaggcacagtggctcatgcctgtaatcccagcactttgggaggctgaggcaggcggatcacctgaggtcaggagttcaagaccagcctggccaacatggtgaaaccccgtctctactaaaaatccaaaaaattagccgggcttggtggtgtgcacctgtaattccagctactcgggaggctgaggcaggagaattgcttgagcccgggaggcagaggctgcagtgaaccaagatcatgccactgcactccagcctgggcaacacagcgagactccgtctcaaaaagaaaaagtttggatcaggcagggtggctcacacctgtaatccctgcactttgggaggccaaggtgggaggatcagttgagccccagagttcaagaccagcctgggcaatgtagtaagacccccatcgctacaaaaaatacaaaagttagccaggtacagtagtacacacctgtagtccaagctacttgggaggctgaagtgggaggatcatttgtgcccaggttgaggctatagtgagccatgatcataccactgcactccagcctgggtgacagagcgagaccctgtctcaaaaaaaaaaaagaatttggagatggttctgcccactctggtttctctgaaaaaacgaggtaattccctgagcccaaccctgatcctcaaggacctgtaattgtgtggtatttaaaattaaaataacattatttttattttgactttttttcaaacagtaagaataatatatcagcagcatgtatctgccaatcatatgtaataaatttcttattttgcc

SEQ ID NO: 372900 - DNA, 722 bp, Homo sapiens
ttgggcacaagccttttttatttcacagaaggcctccgaaagtggatggtgcaacacggtggggacggctgggtggtggaggaaaacaggacaaccgtgcctggggccccttctcagacgtgcttcgtgacttcattcaggtgaatgcccctgctatccaaaggtccggccccttgttgagaaaggcctgcctgttctcattaccctgtctcctgcattcccagctggtgttgcaagaagcaggtcttggacctagaggaggagggtctgtggccagaactgctggatagtggcaggattgagatttgtgtctctgactggtgagtgtgacgattaaaatagccccttgctaagcactgactgcatgtgacatggcctttttatgggtgacttaatttaggcctcctaacccctccttacagataaaaaatctgaagttcaggccagccatggtggctcacacctataatcccagcacttcggggggtcgaggcaggcagatcacttgaggtcaggagttcgagaccagcccaaccagcatggcaaaacctcgtctctactaaaaatacaaaaaaaaaattagccgggcctggtagtgcacacctgtagtcccacatacttgggtggctgaggcaggagaattacttgaacccaggaggtggaggttgtaccactacactccagcctggacgacagagtgagactcagtcctggaaaaaaaa

SEQ ID NO: 372901 - DNA, 2411 bp, Homo sapiens
  misc_feature (3)..(3): n is a, c, g, or t
  misc_feature (5)..(5): n is a, c, g, or t
  misc_feature (7)..(7): n is a, c, g, or t
ggngngnggggagcttgcggcacagctagggcatcccggcgaggagcgccgccaggccccgggccacagccgggcctggcggggggaccatgggcgcctcggtctccaggggccgggccgcccgggtccccgcgccggagccggaacccgaagaggcgctggacctgagccaactacccccagagctgcttctggtggtgctgagccacgtccccccgcgcacgctgctcgggcgctgccgccaagtgtgccggggctggcgagccctggtggacggccaggccctgtggctgctgatcctggcccgcgaccacggcgccaccggccgcgcgctgctgcacctcgcccgcagctgccagtctcccgcccgtaacgccaggccttgccccctgggccgcttctgcgcgcgcagacccatcggacgcaaccttattcgcaacccctgcggccaagaaggcctccgaaagtggatggtgcaacacggtggggacggctgggtggtggaggaaaacaggacaaccgtgcctggggccccttctcagacgtgcttcgtgacttcattcaggtgaatgcccctgctatccaaaggtccggccccttgttgagaaaggcctgcctgttctcattaccctgtctcctgcattcccagctggtgttgcaagaagcaggtcttggacctagaggaggagggtctgtggccagaactgctggatagtggcaggattgagatttgtgtctctgactggtggggagcccgacacgacagcggctgtatgtacagactcctcgtccaacttctagacgccaaccagactgttctagataaattctctgctgtgcctgatcccatcccgcagtggaacaacaatgcctgccttcacgtcacccacgtgttctccaacatcaagatgggcgtccgctttgtgtctttcgaacaccggggccaggacacacagttctgggctggccactatggagcccgtgtgaccaactccagtgtgatcgtgcgagtccgtctgtcctagtccagcactacccttcttgcaagacagcctgactgtgccttccagggcctgggaccattggctgggacccctcattaaccaaccaagcacttgtacctccctggcatactgggaattcctgggtccaatcaaaggccctgacgggccctgtcttcaggttctagaaactaccagaagaagcttcttccatcttatctacctactgcagctgctgctttgcgggggggccctactgtactgaggggaaacccacaagtgagcatgggggaatgcccatcctggagaagaattcttgccctcccctctcttctcctcccaaccaaaaccctccgatccagccccaggcccctctgtaccatcccctcccctccgcaccactgacctcttgtctcctattgtttctgccacagggacttccttggtcccttcagggaagccctcaactcatctctgaacttagaatctcatccttagggctcagagagtcccagccctaagggtgtgaacctcacctcctggggcttccgagctacagggctgggaccaggtcatgcagctgaaagtctacgttaaaaaaaaaaagtttgggccaggcacagtggctcatgcctgtaatcccagcactttgggaggctgaggcaggcggatcacctgaggtcaggagttcaagaccagcctggccaacatggtgaaaccccgtctctactaaaaatccaaaaaattagccgggcttggtggtgtgcacctgtaattccagctactcgggaggctgaggcaggagaattgcttgagcccgggaggcagaggctgcagtgaaccaagatcatgccactgcactccagcctgggcaacacagcgagactccgtctcaaaaagaaaaagtttggatcaggcagggtggctcacacctgtaatccctgcactttgggaggccaaggtgggaggatcagttgagccccagagttcaagaccagcctgggcaatgtagtaagacccccatcgctacaaaaaatacaaaagttagccaggtacagtagtacacacctgtagtccaagctacttgggaggctgaagtgggaggatcatttgtgcccaggttgaggctatagtgagccatgatcataccactgcactccagcctgggtgacagagcgagaccctgtctcaaaaaaaaaaaagaatttggagatggttctgcccactctggtttctctgaaaaaacgaggtaattccctgagcccaaccctgatcctcaaggacctgtaattgtgtggtatttaaaattaaaataacattatttttattttgactttttttcaaacagtaagaataatatatcagcagcatgtatctgccaatcatatgtaataaatttcttattttgcc

SEQ ID NO: 372902 - DNA, 1314 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (1304)..(1304): n is a, c, g, or t
ggngngnggggagcttgcggcacagctagggcatcccggcgaggagcgccgccaggccccgggccacagccgggcctggcggggggaccatgggcgcctcggtctccaggggccgggccgcccgggtccccgcgccggagccggaacccgaagaggcgctggacctgagccaactacccccagagctgcttctggtggtgctgagccacgtccccccgcgcacgctgctcgggcgctgccgccaagtgtgccggggctggcgagccctggtggacggccaggccctgtggctgctgatcctggcccgcgaccacggcgccaccggccgcgcgctgctgcacctcgcccgcagctgccagtctcccgcccgtaacgccaggccttgccccctgggccgcttctgcgcgcgcagacccatcggacgcaaccttattcgcaacccctgcggccaagaaggcctccgaaagtggatggtgcaacacggtggggacggctgggtggtggaggaaaacaggacaaccgtgcctggggccccttctcagacgtgcttcgtgacttcattcagctggtgttgcaagaagcaggtcttggacctagaggaggagggtctgtggccagaactgctggatagtggcaggattgagatttgtgtctctgactggtggggagcccgacacgacagcggctgtatgtacagactcctcgtccaacttctagacgccaaccagactgttctagataaattctctgctgtgcctgatcccatcccgcagtggaacaacaatgcctgccttcacagacacagtttcactatgttgcctgggctggtcttgaactcctgtgctcaagcaatcctctcgcctcagcctcccacagtgctgggattacaggcacaagccactgcatccagcccgtgcgtgtttttgagtgcaccaattccagctctaagattgacgaggtaaaaaggcttaggaaagccttgtttgtcacttgcacttgaaacagaaccttctagcctgcagcatcttggctttgctgctgccaaagaacagccactgacttgtggcttcctgaattcacagatcctactggcctggacctgactgtaagccaaaacctgatactgctgtctgctctgtgctgtttcagtctcagcatgtgctgtgctaaattaaaaacgggcgcacactccaggaacagcacttcgactatgagaccattgcagacttagggcaccctccgtgggacctaaactgaaaacatcatggatgctgactgtactccagcctgggatgacagagggnactccgtcta

SEQ ID NO: 372903 - DNA, 1481 bp, Homo sapiens
  misc_feature (3)..(3): n is a, c, g, or t
  misc_feature (5)..(5): n is a, c, g, or t
  misc_feature (7)..(7): n is a, c, g, or t
ggngngnggggagcttgcggcacagctagggcatcccggcgaggagcgccgccaggccccgggccacagccgggcctggcggggggaccatgggcgcctcggtctccaggggccgggccgcccgggtccccgcgccggagccggaacccgaagaggcgctggacctgagccaactacccccagagctgcttctggtggtgctgagccacgtccccccgcgcacgctgctcgggcgctgccgccaagtgtgccggggctggcgagccctggtggacggccaggccctgtggctgctgatcctggcccgcgaccacggcgccaccggccgcgcgctgctgcacctcgcccgcagctgccagtctcccgcccgtaacgccaggccttgccccctgggccgcttctgcgcgcgcagacccatcggacgcaaccttattcgcaacccctgcggccaagaaggcctccgaaagtggatggtgcaacacggtggggacggctgggtggtggaggaaaacaggacaaccgtgcctggggccccttctcagacgtgcttcgtgacttcattcagctggtgttgcaagaagcaggtcttggacctagaggaggagggtctgtggccagaactgctggatagtggcaggattgagatttgtgtctctgactggtggggagcccgacacgacagcggctgtatgtacagactcctcgtccaacttctagacgccaaccagactgttctagataaattctctgctgtgcctgatcccatcccgcagtggaacaacaatgcctgccttcacagacacagtttcactatgttgcctgggctggtcttgaactcctgtgctcaagcaatcctctcgcctcagcctcccacagtgctgggattacaggcacaagccactgcatccagcccgtgcgtgtttttgagtgcaccaattccagctctaagattgacgaggtaaaaaggcttaggaaagccttgtttgtcacttgcacttgaaacagaaccttctagcctgcagcatcttggctttgctgctgccaaagaacagccactgacttgtggcttcctgaattcacagatcctactggcctggacctgactgtaagccaaaacctgatactgctgtctgctctgtgctgtttcagtctcagcatgtgctgtgctaaattaaaaacgggcgcacactccaggaacagcacttcgactatgagaccattgcagacttagggcaccctccgtgggacctaaactgaaaacatcatggatgctgactggaccatctggatcacataaaaatgcccacaggaaagggcttctttttgttttttgagacggagtctcactgtctcccccaggctggagtgcagtgagctgaaatcgcgtaccacactccagcctgggtgacagagcgagactgtgtttcaaagaaaaaaaaaaacaagcagccttttgcttggttggaatctgaaaaaaaaaa

SEQ ID NO: 372904 - DNA, 1448 bp, Homo sapiens
  misc_feature (3)..(3): n is a, c, g, or t
  misc_feature (5)..(5): n is a, c, g, or t
  misc_feature (7)..(7): n is a, c, g, or t
ggngngnggggagcttgcggcacagctagggcatcccggcgaggagcgccgccaggccccgggccacagccgggcctggcggggggaccatgggcgcctcggtctccaggggccgggccgcccgggtccccgcgccggagccggaacccgaagaggcgctggacctgagccaactacccccagagctgcttctggtggtgctgagccacgtccccccgcgcacgctgctcgggcgctgccgccaagtgtgccggggctggcgagccctggtggacggccaggccctgtggctgctgatcctggcccgcgaccacggcgccaccggccgcgcgctgctgcacctcgcccgcagctgccagtctcccgcccgtaacgccaggccttgccccctgggccgcttctgcgcgcgcagacccatcggacgcaaccttattcgcaacccctgcggccaagaaggcctccgaaagtggatggtgcaacacggtggggacggctgggtggtggaggaaaacaggacaaccgtgcctggggccccttctcagacgtgcttcgtgacttcattcagctggtgttgcaagaagcaggtcttggacctagaggaggagggtctgtggccagaactgctggatagtggcaggattgagatttgtgtctctgactggtggggagcccgacacgacagcggctgtatgtacagactcctcgtccaacttctagacgccaaccagactgttctagataaattctctgctgtgcctgatcccatcccgcagtggaacaacaatgcctgccttcacagacacagtttcactatgttgcctgggctggtcttgaactcctgtgctcaagcaatcctctcgcctcagcctcccacagtgctgggattacaggcacaagccactgcatccagcccgtgcgtgtttttgagtgcaccaattccagctctaagattgacgagacggagtctcactgtctcccccaggctggagtgcagtggcgtgatctcagctcactgcaagctctgcctcccaggttcacgccattctcctgcctcagcctcccgagtagctgggactacaggcgcccaccaccacacccggctaatttttcgtatttttagtagagacggggtttcaccgtattagccaggatggtctcgatctcctgacctcgtgatccgctgccttggcctcccaaagtgctgggattacagatgtgagccaccacgccaggccaaggaaagggcttcttctttgaggaaaccatctacaatcaactggcttcttggctctatatttctttctttttattttcttttattttttttaatttttttttagacggagtctccttctgtcacccatgctggagtgcagtggtgtgatctcagctcactgcaacctccacctcctgggttcaagcaattctcctgcctcagcctcccaagt

SEQ ID NO: 372905 - DNA, 1731 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (1703)..(1703): n is a, c, g, or t
ggngngnggggagcttgcggcacagctagggcatcccggcgaggagcgccgccaggccccgggccacagccgggcctggcggggggaccatgggcgcctcggtctccaggggccgggccgcccgggtccccgcgccggagccggaacccgaagaggcgctggacctgagccaactacccccagagctgcttctggtggtgctgagccacgtccccccgcgcacgctgctcgggcgctgccgccaagtgtgccggggctggcgagccctggtggacggccaggccctgtggctgctgatcctggcccgcgaccacggcgccaccggccgcgcgctgctgcacctcgcccgcagctgccagtctcccgcccgtaacgccaggccttgccccctgggccgcttctgcgcgcgcagacccatcggacgcaaccttattcgcaacccctgcggccaagaaggcctccgaaagtggatggtgcaacacggtggggacggctgggtggtggaggaaaacaggacaaccgtgcctggggccccttctcagacgtgcttcgtgacttcattcagctggtgttgcaagaagcaggtcttggacctagaggaggagggtctgtggccagaactgctggatagtggcaggattgagatttgtgtctctgactggtggggagcccgacacgacagcggctgtatgtacagactcctcgtccaacttctagacgccaaccagactgttctagataaattctctgctgtgcctgatcccatcccgcagtggaacaacaatgcctgccttcacgtcacccacgtgttctccaacatcaagatgggcgtccgctttgtgtctttcgaacaccggggccaggacacacagttctgggctggccactatggagcccgtgtgaccaactccagtgtgatcgtgcgagtccgtctgtcctagtccagcactacccttcttgcaagacagcctgactgtgccttccagggcctgggaccattggctgggacccctcattaaccaaccaagcacttgtacctccctggcatactgggaattcctgggtccaatcaaaggccctgacgggccctgtcttcaggttctagaaactaccagaagaagcttcttccatcttatctacctactgcagctgctgctttgcgggggggccctactgtactgaggggaaacccacaagtgagcatgggggaatgcccatcctggagaagaattcttgccctcccctctcttctcctcccaaccaaaaccctccgatccagccccaggcccctctgtaccatcccctcccctccgcaccactgacctcttgtctcctattgtttctgccacagggacttccttggtcccttcagggaagccctcaactcatctctgaacttagaatctcatccttagggctcagagagtcccagccctaagggtgtgaacctcacctcctggggcttccgagctacagggctgggaccaggtcatgcagctgaaagtctacgttaaaaaaaaaaagtttgggccaggcacagtgtggctctcatgtgccgtgtaattcccaggccacttgtggggacgggcctgacggcagggcggatttcacctgtgagggctccagggagttctcaaaggaccaggccctgtggtgcccaaaacatgtgggcgtgaaaaaaaacgcgccgcgggttcgttccnataagctgttagaaacaagaagtttccc

SEQ ID NO: 372906 - DNA, 1902 bp, Homo sapiens
ttgggcacaagccttttttatttcacagaaggcctccgaaagtggatggtgcaacacggtggggacggctgggtggtggaggaaaacaggacaaccgtgcctggggccccttctcagacgtgcttcgtgacttcattcagctggtgttgcaagaagcaggtcttggacctagaggaggagggtctgtggccagaactgctggatagtggcaggattgagatttgtgtctctgactggtggggagcccgacacgacagcggctgtatgtacagactcctcgtccaacttctagacgccaaccagactgttctagataaattctctgctgtgcctgatcccatcccgcagtggaacaacaatgcctgccttcacgtcacccacgtgttctccaacatcaagatgggcgtccgctttgtgtctttcgaacaccggggccaggacacacagttctgggctggccactatggagcccgtgtgaccaactccagtgtgatcgtgcgagtccgtctgtcctagtccagcactacccttcttgcaagacagcctgactgtgccttccagggcctgggaccattggctgggacccctcattaaccaaccaagcacttgtacctccctggcatactgggaattcctgggtccaatcaaaggccctgacgggccctgtcttcaggttctagaaactaccagaagaagcttcttccatcttatctacctactgcagctgctgctttgcgggggggccctactgtactgaggggaaacccacaagtgagcatgggggaatgcccatcctggagaagaattcttgccctcccctctcttctcctcccaaccaaaaccctccgatccagccccaggcccctctgtaccatcccctcccctccgcaccactgacctcttgtctcctattgtttctgccacagggacttccttggtcccttcagggaagccctcaactcatctctgaacttagaatctcatccttagggctcagagagtcccagccctaagggtgtgaacctcacctcctggggcttccgagctacagggctgggaccaggtcatgcagctgaaagtctacgttaaaaaaaaaaagtttgggccaggcacagtggctcatgcctgtaatcccagcactttgggaggctgaggcaggcggatcacctgaggtcaggagttcaagaccagcctggccaacatggtgaaaccccgtctctactaaaaatccaaaaaattagccgggcttggtggtgtgcacctgtaattccagctactcgggaggctgaggcaggagaattgcttgagcccgggaggcagaggctgcagtgaaccaagatcatgccactgcactccagcctgggcaacacagcgagactccgtctcaaaaagaaaaagtttggatcaggcagggtggctcacacctgtaatccctgcactttgggaggccaaggtgggaggatcagttgagccccagagttcaagaccagcctgggcaatgtagtaagacccccatcgctacaaaaaatacaaaagttagccaggtacagtagtacacacctgtagtccaagctacttgggaggctgaagtgggaggatcatttgtgcccaggttgaggctatagtgagccatgatcataccactgcactccagcctgggtgacagagcgagaccctgtctcaaaaaaaaaaaagaatttggagatggttctgcccactctggtttctctgaaaaaacgaggtaattccctgagcccaaccctgatcctcaaggacctgtaattgtgtggtatttaaaattaaaataacattatttttattttgactttttttcaaacagtaagaataatatatcagcagcatgtatctgccaatcatatgtaataaatttcttattttgcc

SEQ ID NO: 372907 - DNA, 1889 bp, Homo sapiens
  misc_feature (3)..(3): n is a, c, g, or t
  misc_feature (5)..(5): n is a, c, g, or t
  misc_feature (7)..(7): n is a, c, g, or t
ggngngnggggagcttgcggcacagctagggcatcccggcgaggagcgccgccaggccccgggccacagccgggcctggcggggggaccatgggcgcctcggtctccaggggccgggccgcccgggtccccgcgccggagccggaacccgaagaggcgctggacctgagccaactacccccagagctgcttctggtggtgctgagccacgtccccccgcgcacgctgctcgggcgctgccgccaagtgtgccggggctggcgagccctggtggacggccaggccctgtggctgctgatcctggcccgcgaccacggcgccaccggccgcgcgctgctgcacctcgcccgcagctgccagtctcccgcccgtaacgccaggccttgccccctgggccgcttctgcgcgcgcagacccatcggacgcaaccttattcgcaacccctgcggccaagaaggcctccgaaagtggatggtgcaacacggtggggacggctgggtggtggaggaaaacaggacaaccgtgcctggggccccttctcagacgtgcttcgtgacttcattcagctggtgttgcaagaagcaggtcttggacctagaggaggagggtctgtggccagaactgctggatagtggcaggattgagatttgtgtctctgactggtggggagcccgacacgacagcggctgtatgtacagactcctcgtccaacttctagacgccaaccagactgttctagataaattctctgctgtgcctgatcccatcccgcagtggaacaacaatgcctgccttcactgctcctcaatgctgaattcatcttgaaatgtcaggcaactgcagctgcagacctcaatctatgagacacagtttcactatgttgcctgggctggtcttgaactcctgtgctcaagcaatcctctcgcctcagcctcccacagtgctgggattacaggcacaagccactgcatccagcccgtgcgtgtttttgagtgcaccaattccagctctaagattgacgaggtaaaaaggcttaggaaagccttgtttgtcacttgcacttgaaacagaaccttctagcctgcagcatcttggctttgctgctgccaaagaacagccactgacttgtggcttcctgaattcacagatcctactggcctggacctgactgtaagccaaaacctgatactgctgtctgctctgtgctgtttcagtctcagcatgtgctgtgctaaattaaaaacgggcgcacactccaggaacagcacttcgactatgagaccattgcagacttagggcaccctccgtgggacctaaactgaaaacatcatggatgctgactggaccatctggatcacataaaaatgcccacaggaaagggcttctttttgttttttgagacggagtctcactgtctcccccaggctggagtgcagtggcgtgatctcagctcactgcaagctctgcctcccaggttcacgccattctcctgcctcagcctcccgagtagctgggactacaggcgcccaccaccacacccggctaatttttcgtatttttagtagagacggggtttcaccgtattagccaggatggtctcgatctcctgacctcgtgatccgctgccttggcctcccaaagtgctgggattacagatgtgagccaccacgccaggccaaggaaagggcttcttctttgaggaaaccatctacaatcaactggcttcttggctctatatttctttctttttattttcttttattttttttaatttttttttagacggagtctccttctgtcacccatgctggagtgcagtggtgtgatctcagctcactgcaacctccacctcctgggttcaagcaattctcctgcctcagcctcccaagt

SEQ ID NO: 372908 - DNA, 628 bp, Homo sapiens
catcccggcgaggagcgccgccaggccccggggtaggacttggggtgcggtgtcggtgcggccgccgaggggggctgattgcatgcaattcggggcatacacacagaccgcggggtctccgggatatcggggctatcaaggacgggctgggggatggggacttggggacggggcccagggatggtgaagacgggggtgcggctggcagaatcagggcaggcagaggctgcgcgccgcggaggctgctggtccctgacgccttgacccttcctctcccgcagccacagccgggcctggcggggggaccatgggcgcctcggtctccaggggccgggccgcccgggtccccgcgccggagccggaacccgaagaggcgctggacctgagccaactacccccagagctgcttctggtggtgctgagccacgtccccccgcgcacgctgctcgggcgctgccgccaagtgtgccggggctggcgagccctggtggacggccaggccctgtggctgctgatcctggcccgcgaccacggcgccaccggccgcgcgctgctgcacctcgcccgcagctgccagtctcccgcccgtaacgccaggccttgccccctgggccgcttctgcgcgcgc

SEQ ID NO: 372909 - DNA, 2442 bp, Homo sapiens
aggctgtaccggtcccgaatttttgggcatcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggcgctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagaggcccccagaatgagaagtgacaacaaggaaaatccacaacaggaaggggctaaaggagcaaagccatgtgcagtgtcagctggcagatccaaagggaatggtctgcagaatcctgaaccaagaggggcaaatatgagtgaacctcggttgtcacggaggcaggtcagctccccaaatgctcaaaagccatttgctcactaccagagacattgcagggtggaatacatcagcagccccctaaaaagccacccactgagagagctaaagaaaagcaaaggaggtaaacggagtctgagcaaccgtttgcaacatcttggtcaccagcccacccgctcagcaaagaaaccctacaaatgtgatgactgtgggaaaagcttcacgtggaattcagagctgaagagacacaagagagtccacacaggagagagaccctacacgtgcggagagtgtggaaactgctttgggcggcagtcaaccctgaagctgcaccagaggatccacactggagagaagccataccagtgtggccagtgtgggaaaagctttcgccagagctcaaaccttcaccagcatcaccgacttcaccatggggactaaaaggagcactccatgctttagattcacacggaaggtgtttgtgtttctcctcccccttacttgcatgtaaatcacaaaaactgtgtgacttacaaggaaagcacgaggcccttgaggaatgatgatgcacattctgctgtgaggaggcccagaaaaggccaaccagggcccaaccgtgcatgatgacagggtgaagagaaggcaggtctgggcactggggcaaagagaacttaagtctctgcagagagcaaggagtaactactgagagagaatcaggacaatcctgcaggtggcccgcttactgttaaatcgtccctctgttgctttatcctctaaaatatgttaagggataaattctatatatatagttatgcatttgctgtcataccagacaattttttatcatgagcacacttctttaataaagatgagtgatctaccagaaaaaaaaaaggcaaag

SEQ ID NO: 372910 - DNA, 2400 bp, Homo sapiens
cgcggacgtggcatctggcccgccgcggtcgcgttcgtctatctggtctggtccgaagttgatcgtgcagtgtgcggcgcgtgtcggtacgtgtccatcgcagtcgactcacacggcgtgatcagtggcatcggtgcggagtcgcagctggctgtggcgcggctgctgagctgacactggctgcgggctcgaggagcacgttgtcgcgtcaggagtgtcgtactcaacccgctggctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggcgctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagaggcccccagaatgagaagtgacaacaaggaaaatccacaacaggaaggggctaaaggagcaaagccatgtgcagtgtcagctggcagatccaaagggaatggtctgcagaatcctgaaccaagaggggcaaatatgagtgaacctcggttgtcacggaggcaggtcagctccccaaatgctcaaaagccatttgctcactaccagagacattgcagggtggaatacatcagcagccccctaaaaagccacccactgagagagctaaagaaaagcaaaggaggtaaacggagtctgagcaaccgtttgcaacatcttggtcaccagcccacccgctcagcaaagaaaccctacaaatgtgatgactgtgggaaaagcttcacgtggaattcagagctgaagagacacaagagagtccacacaggagagagaccctacacgtgcggagagtgtggaaactgctttgggcggcagtcaaccctgaagctgcaccagaggatccacactggagagaagccataccagtgtggccagtgtgggaaaagctttcgccagagctcaaaccttcaccagcatcaccgacttcaccatggggactaaaaggagcactccatgctttagattcacacggaaggtgtttgtgtttctcctcccccttacttgcatgtaaatcacaaaaactgtgtgacttacaaggaaagcacgaggcccttgaggaatgatgatgcacattctgctgtgaggaggcccagaaaaggccaaccagggcccaaccgtgcatgatgacagggtgaagagaaggcaggtctgggcactggggcaaagagaacttaagtctctgcagagagcaaggagtaactactgagagagaatcaggacaatcctgcaggtggcccgcttactgttaaatcgtccctctgttgctttatcctctaaaatatgttaagggataaattctatatatatagttatgcatttgctgtcataccagacaattttttatcatgagcacacttctttaataaagatgagtgatctaccagaaaaaaaaaaggcaaag

SEQ ID NO: 372911 - DNA, 2463 bp, Homo sapiens
caaaaaaaaaaaaaaaaaaaaaaaaaaaaaaaaaaaatcggccccgcccccagcccgtgctcgccggtgtcgggtcctaagtccctcggtcttgggttcccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggcgctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagaacttcttatagaaaagacagatccaaatatggccacagatgaacttccatgcaagctatggctgagtttcattgcttaaaatgctcctctgtttagaggggcctggtagaaataaaaacccaccctatatcttatatctttgtcctcctctgtgatgttgcttgtacttcagatcctcaaatctatttccctttctctggtgtgatacttgtgtaactgctggccttgttctacacagtcctgtgatctctaagcctgaatgacagtgacatttggccaagcctggtgatgtgaatacaagatacagtgagcacgttagggaggagggttacaagatgacaaaaatcctcagtttcttaatatttgctacatccaatgaggtacttcgtgttttagtctgttcaggctgctaatataaaatgctagagactaggtagtttataaacaacaggagtttatttctcacagttctagaggctaggaagtctgagttcaaggtgccagcatggttgggttccagtgaggcccctcttccaggtcacagactgcctacttctcagtcctcatgtggcagaaggggaagacaggctcccgtggggctctttcatgaaggcactaatcccattccagtgagggcagcaccctcatgacctaatcacctcccaaaggccccatgtcctaacactattaccttgggagttagaatttcatatgaatttggaggaacataaacatttagcccctggcaaccacagtctactttttgtctctagaattgcttattctgaacattttatacaaatggaatcacacaggccaggcacagtggctcacgcctgtaatcccagcactttgggaggccaaggcaggcggatcacttaggctcaggagttcgagaccagcctgggcaacatggcgaaatcctgtctctacaaaaaatgcaaaaattagcggggcatggtgctgcacacctgtaatcccagctgcttgggggag

SEQ ID NO: 372912 - DNA, 1861 bp, Homo sapiens
caaaaaaaaaaaaaaaaaaaaaaaaaaaaaaaaaaaatcggccccgcccccagcccgtgctcgccggtgtcgggtcctaagtccctcggtcttgggttcccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggcgctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacaggtaaacactctgccttttctctccctctcatcagccctttatctccatcaatgtatctcatggttctgcaaaggcatagaccacatgtgtgtgtttttttaaatgttatatataatagtagatgattattcactaaacaaatttcactaattaggatggtggtgatactacaagtaagtatgtttttatcgttttctgttaatgaaaatttaagaatccagtgcatgacagggttgtacctacttttctgtccgtttcagaacttcttatagaaaagacagatccaaatatggccacagatgaacttccatgcaagctatggctgagtttcattgcttaaaatgctcctctgtttagaggggcctggtagaaataaaaacccaccctatatctta

SEQ ID NO: 372913 - DNA, 2525 bp, Homo sapiens
caaaaaaaaaaaaaaaaaaaaaaaaaaaaaaaaaaaatcggccccgcccccagcccgtgctcgccggtgtcgggtcctaagtccctcggtcttgggttcccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggcgctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagaggcccccagaatgagaagtgacaacaaggaaaatccacaacaggaaggggctaaaggagcaaagccatgtgcagtgtcagctggcagatccaaagggaatggtctgcagaatcctgaaccaagaggggcaaatatgagtgaacctcggttgtcacggaggcaggtcagctccccaaatgctcaaaagccatttgctcactaccagagacattgcagggtggaatacatcagcagccccctaaaaagccacccactgagagagctaaagaaaagcaaaggaggtaaacggagtctgagcaaccgtttgcaacatcttggtcaccagcccacccgctcagcaaagaaaccctacaaatgtgatgactgtgggaaaagcttcacgtggaattcagagctgaagagacacaagagagtccacacaggagagagaccctacacgtgcggagagtgtggaaactgctttgggcggcagtcaaccctgaagctgcaccagaggatccacactggagagaagccataccagtgtggccagtgtgggaaaagctttcgccagagctcaaaccttcaccagcatcaccgacttcaccatggggactaaaaggagcactccatgctttagattcacacggaaggtgtttgtgtttctcctcccccttacttgcatgtaaatcacaaaaactgtgtgacttacaaggaaagcacgaggcccttgaggaatgatgatgcacattctgctgtgaggaggcccagaaaaggccaaccagggcccaaccgtgcatgatgacagggtgaagagaaggcaggtctgggcactggggcaaagagaacttaagtctctgcagagagcaaggagtaactactgagagagaatcaggacaatcctgcaggtggcccgcttactgttaaatcgtccctctgttgctttatcctctaaaatatgttaagggataaattctatatatatagttatgcatttgctgtcataccagacaattttttatcatgagcacacttctttaataaagatgagtgatctaccagaaaaaaaaaaggcaaag

SEQ ID NO: 372914 - DNA, 1601 bp, Homo sapiens
caaaaaaaaaaaaaaaaaaaaaaaaaaaaaaaaaaaatcggccccgcccccagcccgtgctcgccggtgtcgggtcctaagtccctcggtcttgggttcccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggcgctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagaacttcttatagaaaagacagatccaaatatggccacagatgaacttccatgcaagctatggctgagtttcattgcttaaaatgctcctctgtttagaggggcctggtagaaataaaaacccaccctatatctta

SEQ ID NO: 372915 - DNA, 2723 bp, Homo sapiens
caaaaaaaaaaaaaaaaaaaaaaaaaaaaaaaaaaaatcggccccgcccccagcccgtgctcgccggtgtcgggtcctaagtccctcggtcttgggttcccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggcgctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacaggtaaacactctgccttttctctccctctcatcagccctttatctccatcaatgtatctcatggttctgcaaaggcatagaccacatgtgtgtgtttttttaaatgttatatataatagtagatgattattcactaaacaaatttcactaattaggatggtggtgatactacaagtaagtatgtttttatcgttttctgttaatgaaaatttaagaatccagtgcatgacagggttgtacctacttttctgtccgtttcagaacttcttatagaaaagacagatccaaatatggccacagatgaacttccatgcaagctatggctgagtttcattgcttaaaatgctcctctgtttagaggggcctggtagaaataaaaacccaccctatatcttatatctttgtcctcctctgtgatgttgcttgtacttcagatcctcaaatctatttccctttctctggtgtgatacttgtgtaactgctggccttgttctacacagtcctgtgatctctaagcctgaatgacagtgacatttggccaagcctggtgatgtgaatacaagatacagtgagcacgttagggaggagggttacaagatgacaaaaatcctcagtttcttaatatttgctacatccaatgaggtacttcgtgttttagtctgttcaggctgctaatataaaatgctagagactaggtagtttataaacaacaggagtttatttctcacagttctagaggctaggaagtctgagttcaaggtgccagcatggttgggttccagtgaggcccctcttccaggtcacagactgcctacttctcagtcctcatgtggcagaaggggaagacaggctcccgtggggctctttcatgaaggcactaatcccattccagtgagggcagcaccctcatgacctaatcacctcccaaaggccccatgtcctaacactattaccttgggagttagaatttcatatgaatttggaggaacataaacatttagcccctggcaaccacagtctactttttgtctctagaattgcttattctgaacattttatacaaatggaatcacacaggccaggcacagtggctcacgcctgtaatcccagcactttgggaggccaaggcaggcggatcacttaggctcaggagttcgagaccagcctgggcaacatggcgaaatcctgtctctacaaaaaatgcaaaaattagcggggcatggtgctgcacacctgtaatcccagctgcttgggggag

SEQ ID NO: 372916 - DNA, 532 bp, Homo sapiens
tgtgatgagcataaatgtaaaatccaagaaatgtttattttgtaaggggaaaaaagtgtgggtagaggagagactcagacaaacctaaatatagatataaattcaaatctcagttcagccactttgtagcttatgtagggggctttggcaaattatctaatttctttgaatcttagattcctcacttttttctttctttttgttttttttgagatagcctctgtcccctgggctggagtacagtgagccgagatggtgccactgcactccagcctggcaacagagcgagactccatctcaaaaaaaaaaaaaaagtaatgacatgattacctaagtgcccctccacacagccccatttctgtaaaaaaaaaaaaagtgcaaaaattggccaggcttggtggcaccagcctgtagtcccaactacttgggaggctgaggtgggaggatcacttgggcctaggaggctgaagatacagtgagtcgagatcacaccactgcacttcagcctcgtcaacagagcgagaccctgtct

SEQ ID NO: 372917 - DNA, 1031 bp, Homo sapiens
ccactgcattcagctcttcttttctttagatatgagagctgaagagcttagacacattttgcatgtattatttgaaaatctgatggaatcccaaagctgaggcaggagaatagcctgaacctgggaatcggaggttgcagggccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaattttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaa

SEQ ID NO: 372918 - DNA, 5873 bp, Homo sapiens
attcagccggtgcgcgcggcggcgggaggcagtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattcttttttttttttttttttgagagagagtcttactctgccgcccaaactggagtgcagtggcacaatcttggctcactgcaacctctacctcctgggttcaagtgattctcttgcctcagcctcccgagttgctgggattacgggcatggtggcgtgagcctgtagtcctagctactcgggaggctgaggcaggagaatagcctgaacctgggaatcggaggttgcagggccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaattttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaa

SEQ ID NO: 372919 - DNA, 5782 bp, Homo sapiens
attcagccggtgcgcgcggcggcgggaggcagtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattcttttttttttttttttttgagagagagtcttactctgccgcccaaactggagtgcagtggcacaatcttggctcactgcaacctctacctcgctgaggcaggagaatagcctgaacctgggaatcggaggttgcagggccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaattttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaa

SEQ ID NO: 372920 - DNA, 5660 bp, Homo sapiens
attcagccggtgcgcgcggcggcgggaggcagtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattcttttttttttttttttttgagagagagtcttactcttccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaattttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaa

SEQ ID NO: 372921 - DNA, 5386 bp, Homo sapiens
agaaagaaacccatacacatacagctgcatctgaaacctcagaaactaagctcaacccaattgattaaaaggatgttctttggataagcagatggacacaaaccatactttgagaaccatgttccacagtgccaatacaggaagtttctagataatggcagctcattttttaaaaatggcactacactatactgtattcacatgccagcaaaactgttaagagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattcttttttttttttttttttgagagagagtcttactctgccgcccaaactggagtgcagtggcacaatcttggctcactgcaacctctacctcctgggttcaagtgattctcttgcctcagcctcccgagttgctgggattacgggcatggtggcgtgagcctgtagtcctagctactcgggaggctgaggcaggagaatagcctgaacctgggaatcggaggttgcagggccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaattttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaa

SEQ ID NO: 372922 - DNA, 4758 bp, Homo sapiens
attcagccggtgcgcgcggcggcgggaggcagtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccatccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaattttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaa

SEQ ID NO: 372923 - DNA, 2647 bp, Homo sapiens
attcagccggtgcgcgcggcggcgggaggcagtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaaagcaaagatcatgagtaaggatttcgtgtgctggtactcgagtcaagagacagcgacctaacgactgttattgtgaaggaagtacgtgactgttttagttagtagccctgggagccttcagtttgatcttcttgctgacagttcgtaggtggtgaaattcatatatggggtactggaacactgtgggtgtagaacaatatcattcacagagtcagaggcgaagagacatggaccctgagcatcagcctgtgttcatgcaagatgagagcagaggctgggagatggaagaagtcgtggggtagcagatggagtaattgtgcacgaggcccag

SEQ ID NO: 372924 - DNA, 6289 bp, Homo sapiens
attcagccggtgcgcgcggcggcgggaggcagtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattcttttttttttttttttttgagagagagtcttactctgccgcccaaactggagtgcagtggcacaatcttggctcactgcaacctctacctcctgggttcaagtgattctcttgcctcagcctcccgagttgctgggattacgggcatggtggcgtgagcctgtagtcctagctactcgggaggctgaggcaggagaatagcctgaacctgggaatcggaggttgcagggccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaattttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaaaaaaaaaaaaaaaaaaacaaaaaaaaaaaaaaaaaaaaaaaaaaaaaaaaaaaaaaaacaaaaaaaacgaaacaaaacaaaaaaaaacaaaacaaaaaacagtgagcgggcacgcgccggcaccgagaaaaaaagaaacagcacacacaactttggggggccgcgggccaccacacagagagcacatcaacgggtgcgcacaagcggtccaacaaacaaaaaaccgcgggagacaaaaaaaagaggagagagagaccccacccacaacagaaaaaaaggaaaccgcgggggaacaaaaagaaacaacgctatcgcgaaacaaacacccaagaaggagaggagacagaggagaagaacaaaggaggaaaatcaacaaacagagagcacaacaaaaaggccacaaacagaaaaaagcg

SEQ ID NO: 372925 - DNA, 5700 bp, Homo sapiens
attcagccggtgcgcgcggcggcgggaggcagtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatgcgggcatggtggcgtgagcctgtagtcctagctactcgggaggctgaggcaggagaatagcctgaacctgggaatcggaggttgcagggccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaattttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaa

SEQ ID NO: 372926 - DNA, 4874 bp, Homo sapiens
caagcacccactaatctaaataggctttaaaattaatttagccatattttttaatcagtccttttgttgtattccttgtatcttttttctttagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattcttttttttttttttttttgagagagagtcttactctgccgcccaaactggagtgcagtggcacaatcttggctcactgcaacctctacctcctgggttcaagtgattctcttgcctcagcctcccgagttgctgggattacgggcatggtggcgtgagcctgtagtcctagctactcgggaggctgaggcaggagaatagcctgaacctgggaatcggaggttgcagggccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaattttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaa

SEQ ID NO: 372927 - DNA, 2287 bp, Homo sapiens
attcagccggtgcgcgcggcggcgggaggcagtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccaggggtatcacctgttagcaagatcagtgactctgctgagcgtcgttttacactcaggaat

SEQ ID NO: 372928 - DNA, 490 bp, Homo sapiens
tctgcacgcctcccgcagcctcagtttccctgtccgtggtactgaggatgctcgggcctagaagttcagggctggaggcccagggaccgtcgagggaggggcatcatccccgccatggggccgccgcaactgcccagagcacaggccaaaggaagctgcaggatgaagacaacagcatcacaaggaggaagccaggatccctgtgttaccacaaggaggagagatgcctaaccaagaccgtctgcaaggattttgtgtgagccagaagcagagctgtatggtgttcagccactgagatttgagggctgtttgttacagcagttgacctatcctgactgacacatcacatcattcctttccccaccatgtgtctaacatgctaccaaattgaattttaagtaaattagtacttataaattaagtacaaatgcttttcaaattcacatgaatctttggtaaataaaactggttgtaaaattattgataaata

SEQ ID NO: 372929 - DNA, 517 bp, Homo sapiens
atgtgactccttaattaggtcacttctctctcctgggaggccctctctgccctctctaagtctaactagtggcaaaggatctaagggaagaaacctggcagagttactagtcccaagaagcctgggtccctgaatcaccacatggaagtctacgcgcccaccacctgaatggactaaggaagctgcaggatgaagacaacagcatcacaaggaggaagccaggatccctgtgttaccacaaggaggagagatgcctaaccaagaccgtctgcaaggattttgtgtgagccagaagcagagctgtatggtgttcagccactgagatttgagggctgtttgttacagcagttgacctatcctgactgacacatcacatcattcctttccccaccatgtgtctaacatgctaccaaattgaattttaagtaaattagtacttataaattaagtacaaatgcttttcaaattcacatgaatctttggtaaataaaactggttgtaaaattattgataaata

SEQ ID NO: 372930 - DNA, 613 bp, Homo sapiens
atgtgactccttaattaggtcacttctctctcctgggaggccctctctgccctctctaagtctaactagtggcaaaggatctaagggaagaaacctggcagagttactagtcccaagaagcctgggtccctgaatcaccacatggaagtctacgcgcccaccacctgaatggactaaggtatgaacagaagtaatacacacccctttagggccaaggaggtgaaacagctggtatgccttcctcacactctcctctgctttcctggtgacctaggaagctgcaggatgaagacaacagcatcacaaggaggaagccaggatccctgtgttaccacaaggaggagagatgcctaaccaagaccgtctgcaaggattttgtgtgagccagaagcagagctgtatggtgttcagccactgagatttgagggctgtttgttacagcagttgacctatcctgactgacacatcacatcattcctttccccaccatgtgtctaacatgctaccaaattgaattttaagtaaattagtacttataaattaagtacaaatgcttttcaaattcacatgaatctttggtaaataaaactggttgtaaaattattgataaata

SEQ ID NO: 372931 - DNA, 341 bp, Homo sapiens
gatttagatttaacaccagagcagcagctggtgcctcgtccattttaggacaactcattcttgtgattagctggaggttcactcttcttcagaagccagaatgtaaacggctcttccctgtgccgtcccccagaggtagcaatcaactgagaggtacagagccaccttccattcaatcagccagccctttgggttcacaaggaaatgacggttggcttttgaaaccaattcttgataagctcacccctaagaatgaaaattttcagggaacaggaaccctgtcctggggaactctgggacacatcattccccacagcattcagattaaaaataccttctat

SEQ ID NO: 372932 - DNA, 335 bp, Homo sapiens
aatttatgggtcagactactggaaacgaaggaggtacacaaagaaaggcctccagaaatctgtacaatttatgggtcagactactggaaacgaaggaggtacacaaagaaaggcctccagaaatctgtacagtcttcggctgaataaaaatttgtgcatacttagggtgaaatcccttgaggccatagaggaaagaaagatctaattaaatatgccgggcattcagtagagacctaggggccacatctcagaagcaaggctaaattagtcccagaaaaaaggctacatagatcagtggttctcaaaagggagggggagattttgcctccaagggg

SEQ ID NO: 372933 - DNA, 755 bp, Homo sapiens
tgataatgaggattgctaattaaatttttcaaaaatagggatggatctctgttaaaaatttttagtgacataggaaaatgcttaagacttaaaaaggaaagatttaaaacttacgttttatacaatcccaattttgttaagtgttttttagtctatgactgaattttgcttttatggcttttgctctcaaaaagtagcaaagctcccaagaaacggtgaggatagaaggggccgtaaaatatcaaacagagattaaatttgtgtatgcacagacctcttttgtttttttttcttcattttcatcacagttttaacagttggccttctgggctatttttatagacaaagttgaactgctgtaaaaagccattctttcccttcctgccttgtctactttcatccttactaggaactcagcaaattcagtacttaataggcaccgagggtatacaatggtgaacaaaaagctcactgttcacttagaaaagacagtcaacggtcacctaaataaatacatcattacaaattgtgctcactactctggacaaaactgcagagtgttacacagaaagaaatgaaggtggagatcagggaatcattttggacaaggaagtttgcaaagacctccataatgaggaagggacacttaaagtcagttttgaagtatgagtaggagttagtctcacaaagtgtggagggaaagcactctatgaagagggacaaggacatagaaaggttttcaagcaaaaaaaaaa

SEQ ID NO: 372934 - DNA, 3826 bp, Homo sapiens
ctcccttcttgtaagagagtgctaggcacatagcctcctcctattcctaatcctcccaccaaagaaagaggcacagagttcattacttagtgggggccagctgtgatcggccaactgccagctgccttaaaaaggaagaccagtgatgctaggatggagtgaaacccaagaggaagtgccatcatgaggaatcaatgagagatctgtgaagagagagggctgggtgggagcccagaaggatagaacctggaagatcaatatctcccgtgagggaaataacaatggagccaggttctaagtcagtgtctaggtcagactggcaacctgaaccacaccagaggcctataaccccgctagagcctgggccagaaaagacacccatagcccagccagaatcgaagactctgcagggatccaatacccaacagaagcctgcttcaaaccaaagacccctcacccagcaggagacccctgcacaacatgatgctgaatcccagaaggaacctagagcccaacaaaaatctgcttcacaagaggaatttcttgccccacagaagcccgcaccacagcaatcaccttacatccaaagggtgctgctcactcaacaggaagctgcctcccagcagggacctgggctaggaaaagaatctataactcaacaggagccagcattgagacaaagacatgtagcccagccagggcctgggccaggagagccacctccagctcaacaagaagctgaatcaacacctgcggcccaggctaaacctggagccaaaagggagccatctgccccgactgaatctacgtcccaagagacacctgaacagtcagacaagcaaacaacgccagtccagggagccaaatccaagcagggatctttgacagagctgggatttctaacaaaacttcaggaactatccatacagcgatcagccctagagtggaaggcactttctgagtgggtcgcagattctgagtcagaatcagatgtgggatcatcttcagacacagattctccagccacgatgggtggaatggtggcccagggagtgaagctaggcttcaaaggaaaatctggttataaagtgatgtcaggatacagtgggacgtcgccacatgagaaaaccagtgctcggaatcacagacactaccaggatacagcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccagttcacgcctgccatccggccattcctgcagaccatctccattgggctggtgtccttcggggagcactacaaacgcaacgagacaggcctcagtgtggccgccagctctctcttcaccagcggccgctttgccatcgaccccgagctgcgtggggctgagtttgagcggatcacacagaacctggacgtgcacttctggaaagccttctggaacatcaccgagatggaagtgctatcgtctctggccaacatggcatcggccaccgtgagggtaagccgcctgctcagcctgccacccgaagcctttgagatgccactgactgccgaccccacgctcacggtcaccatctcacccccactggcccacacaggccctgggcccgtcctcgtcaggctcatctcctatgacctgcgtgaaggacaggacagtgaggagctcagcagcctgataaagtccaacggccaacggagcctggagctgtggccgcgcccccagcaggcaccccgctcgcggtccctgatagtgcacttccacggcggtggctttgtggcccagacctccagatcccacgagccctacctcaagagctgggcccaggagctgggcgcccccatcatctccatcgactactccctggcccctgaggcccccttcccccgtgcgctggaggagtgcttcttcgcctactgctgggccatcaagcactgcgccctccttggctcaacaggggaacgaatctgccttgcgggggacagtgcaggcgggaacctctgcttcaccgtggctcttcgggcagcagcctacggggtgcgggtgccagatggcatcatggcagcctacccggccacaatgctgcagcctgccgcctctccctcccgcctgctgagcctcatggaccccttgctgcccctcagtgtgctctccaagtgtgtcagcgcctatgctggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcagagccgatgcgccgcagtgtgtctgaagcagcactggcccagccccagggcccactgggcacggattccctcaagaacctgaccctgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgagggtttccacccccgacgctccagccagggtgccacacagatgcccctctactcctcacccatagtcaagaaccccttcatgtcgccgctgctggcacccgacagcatgctcaagagcctgccacctgtgcacatcgtggcgtgcgcgctggaccccatgctggacgactcggtcatgctcgcgcggcgactgcgcaacctgggccagccggtgacgctgcgcgtggtggaggacctgccgcacggcttcctgaccctagcggcgctgtgccgcgagacgcgccaggccgcagagctgtgcgtggagcgcatccgcctcgtcctcactcctcccgccggagccgggccgagcggggagacgggggctgcgggggtagacgggggctgcggggggcgacactaaaagcctgttgttcccatctgcgccggcctccgtcatgaatgccttccgggccgggcggaaggggacgcgggctgtgccttacttaagtcgggggtggcaagggggcggggcgggggcccgaaagctgagaccctcgccacggggagggggacgcgcacacacaccggtcaccgagacggctggacctgcacgccaccgctgccttttgctgctgctgctgcggcgaccgccgcagggacggggactggccctcccttgcaggtcggtttggtttgttgtaaataaaagtatttaattagtttggcctctctcaa

SEQ ID NO: 372935 - DNA, 1313 bp, Homo sapiens
agggtgggctgagaggggtaagtggcaggtccaggttacccagtgtggtcacaccacccagtaggaccgacaggcagctcaggcccctagctgagcctggcactgcccttaatcggcttttgtccttccaggagggacaggcagggctggctacctcctctctccccccaacagctggggctggctgtgccagggccagactaggaggcgggagctgagatcactgggcctttggctccctgagtcctctctggggacagagagggcagcctggctgggtgagaggggacggtttgttcaggactggggctaggactcctgggtcctaaaggatgaaggggctgggggcctggactcctgggtctgagggaggaggggctgtgggtgtggactcctgggttctaaggcagaggagcctgtaacaggactaccagttgagctgagtctgggagcaggtggggggcagagcagggagctgagccctctactctgtttacagcacgtggtcctcactgatctttctgggtgggaggtggcttgtgcggctacaccctgggcaggccagccccgcccccgggtttattgccccaggctgctactggcacaagccacagaccagcagtcccagcccagggaagctcggaagatgcctaggagggcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccagttcacgcctgccatccggccattcctgcagaccatctccattgggctggtgtccttcggggagcactacaaacgcaacgagacaggcctcagtgagtcccagccaggttctactcgca

SEQ ID NO: 372936 - DNA, 434 bp, Homo sapiens
aaagtgtacaattttagtgtaatacagcttggaaagttaacccctccgccagggatctggacagcatagaaacacgtagaactcaaggtgtacacatgagatttcggggggcgacactaaaagcctgttgttcccatctgcgccggcctccgtcatgaatgccttccgggccgggcggaaggggacgcgggctgtgccttacttaagtcgggggtggcaagggggcggggcgggggcccgaaagctgagaccctcgccacggggagggggacgcgcacacacaccggtcaccgagacggctggacctgcacgccaccgctgccttttgctgctgctgctgcggcgaccgccgcagggacggggactggccctcccttgcaggtcggtttggtttgttgtaaataaaagtatttaattagtttggcctctctcaa

SEQ ID NO: 372937 - DNA, 393 bp, Homo sapiens
aacgggatgatccattgtgagaagggggtgatgtgacagccgagaggcccaccctggcacagggactagctgacgcccggatcggcttgggagcagagtccggaatgcgagcttcgtggaccagggttcccgctcggattccgtattcgctgtgtgaccaagggcaacggatgccctcagtgtttcccacctggggaatgcttcaagcgccgatgttcagggctccagcgctcttgagaggataagggggaaggaggttagcaggtgttactcaaagaggaagtctagcggtgagtcaaggagaggtaggaggaaggggtgcccatagtggagagtgcagcggggccagtaaagttcatcgcagtcccggcctcccacccggcaagtcagtcc

SEQ ID NO: 372938 - DNA, 3598 bp, Homo sapiens
ctcccttcttgtaagagagtgctaggcacatagcctcctcctattcctaatcctcccaccaaagaaagaggcacagagttcattacttagtgggggccagctgtgatcggccaactgccagctgccttaaaaaggaagaccagtgatgctaggatggagtgaaacccaagaggaagtgccatcatgaggaatcaatgagagatctgtgaagagagagggctgggtgggagcccagaaggatagaacctggaagatcaatatctcccgtgagggaaataacaatggagccaggttctaagtcagtgtctaggtcagactggcaacctgaaccacaccagaggcctataaccccgctagagcctgggccagaaaagacacccatagcccagccagaatcgaagactctgcagggatccaatacccaacagaagcctgcttcaaaccaaagacccctcacccagcaggagacccctgcacaacatgatgctgaatcccagaaggaacctagagcccaacaaaaatctgcttcacaagaggaatttcttgccccacagaagcccgcaccacagcaatcaccttacatccaaagggtgctgctcactcaacaggaagctgcctcccagcagggacctgggctaggaaaagaatctataactcaacaggagccagcattgagacaaagacatgtagcccagccagggcctgggccaggagagccacctccagctcaacaagaagctgaatcaacacctgcggcccaggctaaacctggagccaaaagggagccatctgccccgactgaatctacgtcccaagagacacctgaacagtcagacaagcaaacaacgccagtccagggagccaaatccaagcagggatctttgacagagctgggatttctaacaaaacttcaggaactatccatacagcgatcagccctagagtggaaggcactttctgagtgggtcgcagattctgagtcagaatcagatgtgggatcatcttcagacacagattctccagccacgatgggtggaatggtggcccagggagtgaagctaggcttcaaaggaaaatctggttataaagtgatgtcaggatacagtgggacgtcgccacatgagaaaaccagtgctcggaatcacagacactaccaggatacagcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccagttcacgcctgccatccggccattcctgcagaccatctccattgggctggtgtccttcggggagcactacaaacgcaacgagacaggcctcagtgtggccgccagctctctcttcaccagcggccgctttgccatcgaccccgagctgcgtggggctgagtttgagcggatcacacagaacctggacgtgcacttctggaaagccttctggaacatcaccgagatggaagtgctatcgtctctggccaacatggcatcggccaccgtgagggtaagccgcctgctcagcctgccacccgaagcctttgagatgccactgactgccgaccccacgctcacggtcaccatctcacccccactggcccacacaggccctgggcccgtcctcgtcaggctcatctcctatgacctgcgtgaaggacaggacagtgaggagctcagcagcctgataaagtccaacggccaacggagcctggagctgtggccgcgcccccagcaggcaccccgctcgcggtccctgatagtgcacttccacggcggtggctttgtggcccagacctccagatcccacgagccctacctcaagagctgggcccaggagctgggcgcccccatcatctccatcgactactccctggcccctgaggcccccttcccccgtgcgctggaggagtgcttcttcgcctactgctgggccatcaagcactgcgccctccttggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcagagccgatgcgccgcagtgtgtctgaagcagcactggcccagccccagggcccactgggcacggattccctcaagaacctgaccctgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgagggtttccacccccgacgctccagccagggtgccacacagatgcccctctactcctcacccatagtcaagaaccccttcatgtcgccgctgctggcacccgacagcatgctcaagagcctgccacctgtgcacatcgtggcgtgcgcgctggaccccatgctggacgactcggtcatgctcgcgcggcgactgcgcaacctgggccagccggtgacgctgcgcgtggtggaggacctgccgcacggcttcctgaccctagcggcgctgtgccgcgagacgcgccaggccgcagagctgtgcgtggagcgcatccgcctcgtcctcactcctcccgccggagccgggccgagcggggagacgggggctgcgggggtagacgggggctgcggggggcgacactaaaagcctgttgttcccatctgcgccggcctccgtcatgaatgccttccgggccgggcggaaggggacgcgggctgtgccttacttaagtcgggggtggcaagggggcggggcgggggcccgaaagctgagaccctcgccacggggagggggacgcgcacacacaccggtcaccgagacggctggacctgcacgccaccgctgccttttgctgctgctgctgcggcgaccgccgcagggacggggactggccctcccttgcaggtcggtttggtttgttgtaaataaaagtatttaattagtttggcctctctcaa

SEQ ID NO: 372939 - DNA, 3412 bp, Homo sapiens
agggtgggctgagaggggtaagtggcaggtccaggttacccagtgtggtcacaccacccagtaggaccgacaggcagctcaggcccctagctgagcctggcactgcccttaatcggcttttgtccttccaggagggacaggcagggctggctacctcctctctccccccaacagctggggctggctgtgccagggccagactaggaggcgggagctgagatcactgggcctttggctccctgagtcctctctggggacagagagggcagcctggctgggtgagaggggacggtttgttcaggactggggctaggactcctgggtcctaaaggatgaaggggctgggggcctggactcctgggtctgagggaggaggggctgtgggtgtggactcctgggttctaaggcagaggagcctgtaacaggactaccagttgagctgagtctgggagcaggtggggggcagagcagggagctgagccctctactctgtttacagcacgtggtcctcactgatctttctgggtgggaggtggcttgtgcggctacaccctgggcaggccagccccgcccccgggtttattgccccaggctgctactggcacaagccacagaccagcagtcccagcccagggaagctcggaagatgcctaggaggggtgagtgtccagccagctgagagacgggaatggccgctgccaggccccaggacctagaagggaaaggaaataccttcttctaggggaacagcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccagttcacgcctgccatccggccattcctgcagaccatctccattgggctggtgtccttcggggagcactacaaacgcaacgagacaggcctcagtgtggccgccagctctctcttcaccagcggccgctttgccatcgaccccgagctgcgtggggctgagtttgagcggatcacacagaacctggacgtgcacttctggaaagccttctggaacatcaccgagatggaagtgctatcgtctctggccaacatggcatcggccaccgtgagggtaagccgcctgctcagcctgccacccgaagcctttgagatgccactgactgccgaccccacgctcacggtcaccatctcacccccactggcccacacaggccctgggcccgtcctcgtcaggctcatctcctatgacctgcgtgaaggacaggacagtgaggagctcagcagcctgataaagtccaacggccaacggagcctggagctgtggccgcgcccccagcaggcaccccgctcgcggtccctgatagtgcacttccacggcggtggctttgtggcccagacctccagatcccacgagccctacctcaagagctgggcccaggagctgggcgcccccatcatctccatcgactactccctggcccctgaggcccccttcccccgtgcgctggaggagtgcttcttcgcctactgctgggccatcaagcactgcgccctccttggctcaacaggggaacgaatctgccttgcgggggacagtgcaggcgggaacctctgcttcaccgtggctcttcgggcagcagcctacggggtgcgggtgccagatggcatcatggcagcctacccggccacaatgctgcagcctgccgcctctccctcccgcctgctgagcctcatggaccccttgctgcccctcagtgtgctctccaagtgtgtcagcgcctatgctggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcagagccgatgcgccgcagtgtgtctgaagcagcactggcccagccccagggcccactgggcacggattccctcaagaacctgaccctgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgagggtttccacccccgacgctccagccagggtgccacacagatgcccctctactcctcacccatagtcaagaaccccttcatgtcgccgctgctggcacccgacagcatgctcaagagcctgccacctgtgcacatcgtggcgtgcgcgctggaccccatgctggacgactcggtcatgctcgcgcggcgactgcgcaacctgggccagccggtgacgctgcgcgtggtggaggacctgccgcacggcttcctgaccctagcggcgctgtgccgcgagacgcgccaggccgcagagctgtgcgtggagcgcatccgcctcgtcctcactcctcccgccggagccgggccgagcggggagacgggggctgcgggggtagacgggggctgcggggggcgacactaaaagcctgttgttcccatctgcgccggcctccgtcatgaatgccttccgggccgggcggaaggggacgcgggctgtgccttacttaagtcgggggtggcaagggggcggggcgggggcccgaaagctgagaccctcgccacggggagggggacgcgcacacacaccggtcaccgagacggctggacctgcacgccaccgctgccttttgctgctgctgctgcggcgaccgccgcagggacggggactggccctcccttgcaggtcggtttggtttgttgtaaataaaagtatttaattagtttggcctctctcaa

SEQ ID NO: 372940 - DNA, 3321 bp, Homo sapiens
agggtgggctgagaggggtaagtggcaggtccaggttacccagtgtggtcacaccacccagtaggaccgacaggcagctcaggcccctagctgagcctggcactgcccttaatcggcttttgtccttccaggagggacaggcagggctggctacctcctctctccccccaacagctggggctggctgtgccagggccagactaggaggcgggagctgagatcactgggcctttggctccctgagtcctctctggggacagagagggcagcctggctgggtgagaggggacggtttgttcaggactggggctaggactcctgggtcctaaaggatgaaggggctgggggcctggactcctgggtctgagggaggaggggctgtgggtgtggactcctgggttctaaggcagaggagcctgtaacaggactaccagttgagctgagtctgggagcaggtggggggcagagcagggagctgagccctctactctgtttacagcacgtggtcctcactgatctttctgggtgggaggtggcttgtgcggctacaccctgggcaggccagccccgcccccgggtttattgccccaggctgctactggcacaagccacagaccagcagtcccagcccagggaagctcggaagatgcctaggagggcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccagttcacgcctgccatccggccattcctgcagaccatctccattgggctggtgtccttcggggagcactacaaacgcaacgagacaggcctcagtgtggccgccagctctctcttcaccagcggccgctttgccatcgaccccgagctgcgtggggctgagtttgagcggatcacacagaacctggacgtgcacttctggaaagccttctggaacatcaccgagatggaagtgctatcgtctctggccaacatggcatcggccaccgtgagggtaagccgcctgctcagcctgccacccgaagcctttgagatgccactgactgccgaccccacgctcacggtcaccatctcacccccactggcccacacaggccctgggcccgtcctcgtcaggctcatctcctatgacctgcgtgaaggacaggacagtgaggagctcagcagcctgataaagtccaacggccaacggagcctggagctgtggccgcgcccccagcaggcaccccgctcgcggtccctgatagtgcacttccacggcggtggctttgtggcccagacctccagatcccacgagccctacctcaagagctgggcccaggagctgggcgcccccatcatctccatcgactactccctggcccctgaggcccccttcccccgtgcgctggaggagtgcttcttcgcctactgctgggccatcaagcactgcgccctccttggctcaacaggggaacgaatctgccttgcgggggacagtgcaggcgggaacctctgcttcaccgtggctcttcgggcagcagcctacggggtgcgggtgccagatggcatcatggcagcctacccggccacaatgctgcagcctgccgcctctccctcccgcctgctgagcctcatggaccccttgctgcccctcagtgtgctctccaagtgtgtcagcgcctatgctggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcagagccgatgcgccgcagtgtgtctgaagcagcactggcccagccccagggcccactgggcacggattccctcaagaacctgaccctgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgagggtttccacccccgacgctccagccagggtgccacacagatgcccctctactcctcacccatagtcaagaaccccttcatgtcgccgctgctggcacccgacagcatgctcaagagcctgccacctgtgcacatcgtggcgtgcgcgctggaccccatgctggacgactcggtcatgctcgcgcggcgactgcgcaacctgggccagccggtgacgctgcgcgtggtggaggacctgccgcacggcttcctgaccctagcggcgctgtgccgcgagacgcgccaggccgcagagctgtgcgtggagcgcatccgcctcgtcctcactcctcccgccggagccgggccgagcggggagacgggggctgcgggggtagacgggggctgcggggggcgacactaaaagcctgttgttcccatctgcgccggcctccgtcatgaatgccttccgggccgggcggaaggggacgcgggctgtgccttacttaagtcgggggtggcaagggggcggggcgggggcccgaaagctgagaccctcgccacggggagggggacgcgcacacacaccggtcaccgagacggctggacctgcacgccaccgctgccttttgctgctgctgctgcggcgaccgccgcagggacggggactggccctcccttgcaggtcggtttggtttgttgtaaataaaagtatttaattagtttggcctctctcaa

SEQ ID NO: 372941 - DNA, 2416 bp, Homo sapiens
aacgggatgatccattgtgagaagggggtgatgtgacagccgagaggcccaccctggcacagggactagctgacgcccggatcggcttgggagcagagtccggaatgcgagcttcgtggaccagggttcccgctcggattccgtattcgctgtgtgaccaagggcaacggatgccctcagtgtttcccacctggggaatgcttcaagcgccgatgttcagggctccagcgctcttgagaggataagggggaaggaggttagcaggtgttactcaaagaggaagtctagcgttcacgcctgccatccggccattcctgcagaccatctccattgggctggtgtccttcggggagcactacaaacgcaacgagacaggcctcagtgtggccgccagctctctcttcaccagcggccgctttgccatcgaccccgagctgcgtggggctgagtttgagcggatcacacagaacctggacgtgcacttctggaaagccttctggaacatcaccgagatggaagtgctatcgtctctggccaacatggcatcggccaccgtgagggtaagccgcctgctcagcctgccacccgaagcctttgagatgccactgactgccgaccccacgctcacggtcaccatctcacccccactggcccacacaggccctgggcccgtcctcgtcaggctcatctcctatgacctgcgtgaaggacaggacagtgaggagctcagcagcctgataaagtccaacggccaacggagcctggagctgtggccgcgcccccagcaggcaccccgctcgcggtccctgatagtgcacttccacggcggtggctttgtggcccagacctccagatcccacgagccctacctcaagagctgggcccaggagctgggcgcccccatcatctccatcgactactccctggcccctgaggcccccttcccccgtgcgctggaggagtgcttcttcgcctactgctgggccatcaagcactgcgccctccttggctcaacaggggaacgaatctgccttgcgggggacagtgcaggcgggaacctctgcttcaccgtggctcttcgggcagcagcctacggggtgcgggtgccagatggcatcatggcagcctacccggccacaatgctgcagcctgccgcctctccctcccgcctgctgagcctcatggaccccttgctgcccctcagtgtgctctccaagtgtgtcagcgcctatgctggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcagagccgatgcgccgcagtgtgtctgaagcagcactggcccagccccagggcccactgggcacggattccctcaagaacctgaccctgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgagggtttccacccccgacgctccagccagggtgccacacagatgcccctctactcctcacccatagtcaagaaccccttcatgtcgccgctgctggcacccgacagcatgctcaagagcctgccacctgtgcacatcgtggcgtgcgcgctggaccccatgctggacgactcggtcatgctcgcgcggcgactgcgcaacctgggccagccggtgacgctgcgcgtggtggaggacctgccgcacggcttcctgaccctagcggcgctgtgccgcgagacgcgccaggccgcagagctgtgcgtggagcgcatccgcctcgtcctcactcctcccgccggagccgggccgagcggggagacgggggctgcgggggtagacgggggctgcggggggcgacactaaaagcctgttgttcccatctgcgccggcctccgtcatgaatgccttccgggccgggcggaaggggacgcgggctgtgccttacttaagtcgggggtggcaagggggcggggcgggggcccgaaagctgagaccctcgccacggggagggggacgcgcacacacaccggtcaccgagacggctggacctgcacgccaccgctgccttttgctgctgctgctgcggcgaccgccgcagggacggggactggccctcccttgcaggtcggtttggtttgttgtaaataaaagtatttaattagtttggcctctctcaa

SEQ ID NO: 372942 - DNA, 489 bp, Homo sapiens
gcggccgctttgccatcgaccccgagctgcgtggggctgagtttgagcggatcacacagaacctggacgtgcacttctggaaagccttctggaacatcaccgagatggaagtgctatcggtgagggcctgttgcagatggggacactgaggcccagagactcatctgaggccacagtaggtctctgtggggctccaggcccagggatggcacacaaggggaaagactggggatcagagggagaggtgaagggcacccctgcaggcagaccttccctagcaccccttctgtcccctccctccagtctctggccaacatggcatcggccaccgtgagggtaagccgcctgctcagcctgccacccgaagcctttgagatgccactgactgccgaccccacgctcacggtcaccatctcacccccactggcccacacaggccctgggcccgtcctcgtcaggctcatctcctatgacctgcgtgaaggacag

SEQ ID NO: 372943 - DNA, 2485 bp, Homo sapiens
ctcccttcttgtaagagagtgctaggcacatagcctcctcctattcctaatcctcccaccaaagaaagaggcacagagttcattacttagtgggggccagctgtgatcggccaactgccagctgccttaaaaaggaagaccagtgatgctaggatggagtgaaacccaagaggaagtgccatcatgaggaatcaatgagagatctgtgaagagagagggctgggtgggagcccagaaggatagaacctggaagatcaatatctcccgtgagggaaataacaatggagccaggttctaagtcagtgtctaggtcagactggcaacctgaaccacaccagaggcctataaccccgctagagcctgggccagaaaagacacccatagcccagccagaatcgaagactctgcagggatccaatacccaacagaagcctgcttcaaaccaaagacccctcacccagcaggagacccctgcacaacatgatgctgaatcccagaaggaacctagagcccaacaaaaatctgcttcacaagaggaatttcttgccccacagaagcccgcaccacagcaatcaccttacatccaaagggtgctgctcactcaacaggaagctgcctcccagcagggacctgggctaggaaaagaatctataactcaacaggagccagcattgagacaaagacatgtagcccagccagggcctgggccaggagagccacctccagctcaacaagaagctgaatcaacacctgcggcccaggctaaacctggagccaaaagggagccatctgccccgactgaatctacgtcccaagagacacctgaacagtcagacaagcaaacaacgccagtccagggagccaaatccaagcagggatctttgacagagctgggatttctaacaaaacttcaggaactatccatacagcgatcagccctagagtggaaggcactttctgagtgggtcgcagattctgagtcagaatcagatgtgggatcatcttcagacacagattctccagccacgatgggtggaatggtggcccagggagtgaagctaggcttcaaaggaaaatctggttataaagtgatgtcaggatacagtgggacgtcgccacatgagaaaaccagtgctcggaatcacagacactaccaggatacagcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccagttcacgcctgccatccggccattcctgcagaccatctccattgggctggtgtccttcggggagcactacaaacgcaacgagacaggcctcagtgtggccgccagctctctcttcaccagcggccgctttgccatcgaccccgagctgcgtggggctgagtttgagcggatcacacagaacctggacgtgcacttctggaaagccttctggaacatcaccgagatggaagtgctatcgtctctggccaacatggcatcggccaccgtgagggtaagccgcctgctcagcctgccacccgaagcctttgagatgccactgactgccgaccccacgctcacggtcaccatctcacccccactggcccacacaggccctgggcccgtcctcgtcaggctcatctcctatgacctgcgtgaaggacaggacagtgaggagctcagcagcctgataaagtccaacggccaacggagcctggagctgtggccgcgcccccagcaggcaccccgctcgcggtccctgatagtgcacttccacggcggtggctttgtggcccagacctccagatcccacgagccctacctcaagagctgggcccaggagctgggcgcccccatcatctccatcgactaacacaccggtcaccgagacggctggacctgcacgccaccgctgccttttgctgctgctgctgcggcgaccgccgcagggacggggactggccctcccttgcaggtcggtttggtttgttgtaaataaaagtatttaattagtttggcctctctcaa

SEQ ID NO: 372944 - DNA, 2092 bp, Homo sapiens
ctcccttcttgtaagagagtgctaggcacatagcctcctcctattcctaatcctcccaccaaagaaagaggcacagagttcattacttagtgggggccagctgtgatcggccaactgccagctgccttaaaaaggaagaccagtgatgctaggatggagtgaaacccaagaggaagtgccatcatgaggaatcaatgagagatctgtgaagagagagggctgggtgggagcccagaaggatagaacctggaagatcaatatctcccgtgagggaaataacaatggagccaggttctaagtcagtgtctaggtcagactggcaacctgaaccacaccagaggcctataaccccgctagagcctgggccagaaaagacacccatagcccagccagaatcgaagactctgcagggatccaatacccaacagaagcctgcttcaaaccaaagacccctcacccagcaggagacccctgcacaacatgatgctgaatcccagaaggaacctagagcccaacaaaaatctgcttcacaagaggaatttcttgccccacagaagcccgcaccacagcaatcaccttacatccaaagggtgctgctcactcaacaggaagctgcctcccagcagggacctgggctaggaaaagaatctataactcaacaggagccagcattgagacaaagacatgtagcccagccagggcctgggccaggagagccacctccagctcaacaagaagctgaatcaacacctgcggcccaggctaaacctggagccaaaagggagccatctgccccgactgaatctacgtcccaagagacacctgaacagtcagacaagcaaacaacgccagtccagggagccaaatccaagcagggatctttgacagagctgggatttctaacaaaacttcaggaactatccatacagcgatcagccctagagtggaaggcactttctgagtgggtcgcagattctgagtcagaatcagatgtgggatcatcttcagacacagattctccagccacgatgggtggaatggtggcccagggagtgaagctaggcttcaaaggaaaatctggttataaagtgatgtcaggatacagtgggacgtcgccacatgagaaaaccagtgctcggaatcacagacactaccaggatacagcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccagttcacgcctgccatccggccattcctgcagaccatctccattgggctggtgtccttcggggagcactacaaacgcaacgagacaggcctcagtgtggccgccagctctctcttcaccagcggccgctttgccatcgaccccgagctgcgtggggctgagtttgagcggatcacacagaacctggacgtgcacttctggaaagctgagaccctcgccacggggagggggacgcgcacacacaccggtcaccgagacggctggacctgcacgccaccgctgccttttgctgctgctgctgcggcgaccgccgcagggacggggactggccctcccttgcaggtcggtttggtttgttgtaaataaaagtatttaattagtttggcctctctcaa

SEQ ID NO: 372945 - DNA, 1463 bp, Homo sapiens
ggaactacaggcgtgcaccaccactaccacgcccagctaatttttgtgtttttcgctatgttgcccaggctggtcttgaactcctgggctcaagccatcctctcgccttggcctcccaaagtactgggactacaggcgtgagccactgcgcccagcctccttatcccttttgaagcgattggatattctcgggtccctgggaccacagatgcctgaagttctgggcgttaaaactgggcccagaaaggggaaaacaactcagctacccacatatattctgcaggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcagagccgatgcgccgcagtgtgtctgaagcagcactggcccagccccagggcccactgggcacggattccctcaagaacctgaccctgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgagggtttccacccccgacgctccagccagggtgccacacagatgcccctctactcctcacccatagtcaagaaccccttcatgtcgccgctgctggcacccgacagcatgctcaagagcctgccacctgtgcacatcgtggcgtgcgcgctggaccccatgctggacgactcggtcatgctcgcgcggcgactgcgcaacctgggccagccggtgacgctgcgcgtggtggaggacctgccgcacggcttcctgaccctagcggcgctgtgccgcgagacgcgccaggccgcagagctgtgcgtggagcgcatccgcctcgtcctcactcctcccgccggagccgggccgagcggggagacgggggctgcgggggtagacgggggctgcggggggcgacactaaaagcctgttgttcccatctgcgccggcctccgtcatgaatgccttccgggccgggcggaaggggacgcgggctgtgccttacttaagtcgggggtggcaagggggcggggcgggggcccgaaagctgagaccctcgccacggggagggggacgcgcacacacaccggtcaccgagacggctggacctgcacgccaccgctgccttttgctgctgctgctgcggcgaccgccgcagggacggggactggccctcccttgcaggtcggtttggtttgttgtaaataaaagtatttaattagtttggcctctctcaa

SEQ ID NO: 372946 - DNA, 765 bp, Homo sapiens
gcacaaacacagccactgcagcctcaacctcatgggctcaggcggtcctccctcagcctctgaaagtgctgggattgcaagtgtaaaccattgtgcctggcctattatacttgacattaaaaagaagatttttgcccgggcatggtgggtcacacctgtaacctcagcacttttggaggccaagggagaaccacttgaggccaggagttcgagaccagcctgggcaacatagtgagacccccatcactacaaaacaaaatattagtcaggtgtggtggcatgcccttatggttccagctgctcaggggggctgaagtggaaggattgcctcagcctgggaggtcaaggctgcagtgacccgtgtttgcgccactgcactccagcctgggtgacagagttagaccctgtctcaaaaaaaaaaaaaaaaaaaaaagatccttaattggagaaatgtcaggatgtagaaagaaaaagtcgtcaatgaaaatggaatatttgagtaaatggagtattatactcacttggggaggttttatttgagttggtttatttgaaattagaatcagtgactttaccggtatgaataacctttagtaatttttcaaactgtgggaccagaggaaataagacctttcattgtttgcctgcaataacaccaaaatatcactgtagtcacctgagtaagttttgttacaaaacacattaatcaaagttcactttctttaggctaatgtgccttttcttacagatgttctttgcatatag

SEQ ID NO: 372947 - DNA, 605 bp, Homo sapiens
tctctctatgtatctgtcaggctatgctgcagtaacaaacagcccccaattcttggtggttgaaaacaacgaaacttatttctcactcatgaaagatgtctagtgctggtcagcggggggcttttctctacagagtcactcagggacccaggctggtgtgggctctgccattttgcaatgttgccatctcaggacagcagaagagaagagagcactagaaagtgtggctcctgtaataagatgatttcacctggaaattacaccagtcatgtttgttcagaatccactgaccagaatgagtcacatgacaccccctaattttaagaagacccagtgataacccgctcactaatataccctgaattgcctgccttcctttctctggctcgcttccccactccctacttcctgatgccctctgggatcactttccaaataaattatatgcacctgaacttgttgtcttagcgtctgcttctggtagagcccaaatgaagacacccctgctctttatcattaattaattcagtctgtcaatacgtattttctgagcacctactatgtgctagatcctatgtaggcactgggggcacgaagatgactga

SEQ ID NO: 372948 - DNA, 218 bp, Homo sapiens
gcaacagggatttccacacatgctcattgctgatagtgcctagtaagtaagttttccagaactggttgttggaaaggttagaacatgaattttgtgaagtttctagaatcgggagtatttgaacctaacctatatctttccaaaattttaagtcctagtagtttgtgagtagctaggttgagttttgtccagacaagaaaacttaactacagaaagtc

SEQ ID NO: 372949 - DNA, 1025 bp, Homo sapiens
aacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggaaaacagatgctgacagaattgtagactaccatgccacacaaaaaggctaaatatctactccaatgggtttccagttcagtttgaagtcaatcaaatttttgtattttcggtgtctccttgattggttttgctagtaattctgtaaattgtacatttgcaatatgaggttttttttccttttgtacaatttgaaactgatgcttcacctttcctttaataaactattcaaaatcaggcttgt

SEQ ID NO: 372950 - DNA, 971 bp, Homo sapiens
aacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggtctactccaatgggtttccagttcagtttgaagtcaatcaaatttttgtattttcggtgtctccttgattggttttgctagtaattctgtaaattgtacatttgcaatatgaggttttttttccttttgtacaatttgaaactgatgcttcacctttcctttaataaactattcaaaatcaggcttgt

SEQ ID NO: 372951 - DNA, 721 bp, Homo sapiens
ggtccggacgcgtgggtcgacccacgcgtcctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372952 - DNA, 325 bp, Homo sapiens
gctcggtaccccagggccccggtatccattcatcaagcctctagcaccacgggagcctccacgagacacaccacgactattgtaatagggctgattgctacgtggaaatccagcgtggtgctagaggcttgatgaatggataccggggccctgccaatggattcagaggtaaaaaaataaaaaaggaggttctaatgaccttttactagttcaaattattttttgatttgtaaaatatatcacacagtttttgggaaggatgtatctgcattagcctcctatgtgcaatttaaacaatgtatattttggtacaatttgtgtattt

SEQ ID NO: 372953 - DNA, 4168 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372954 - DNA, 4179 bp, Homo sapiens
  misc_feature (4096)..(4096): n is a, c, g, or t
  misc_feature (4102)..(4102): n is a, c, g, or t
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagttttgctgtttgaacctaccaatggttggtgtgacttccccttcaagttgtgggggggagggnttccgntttaaaaaaaattggtttaaaaaaagggggctttcggccgcgcccttgaaggcgagataagcgcgaagttactgggg

SEQ ID NO: 372955 - DNA, 4136 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaactgcgctggcatctgtatcacacagtcgtttgaagattattttacttcttctgttggccgggccctgactgctaactcgccttggaagataatcatgaaacaagacaaagaaagcattgaagcaatgaaggctaataa

SEQ ID NO: 372956 - DNA, 5436 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttactatataaactgtcttgaaaactagaacatattctcttctcagaaaaagtgtttttccaactgaaaattatttttcaggtcctaaaacctgctaaatgtttttaggaagtacttactgaaacatttttgtaagacatttttggaatgagattgaacatttatataaatttattattcctctttcatttttttgaaacatgcctattatattttagggccagacaccctttaatggccggataagccatagttctctgatttgagggaggttaaacatcaaacaggtttcctctattggccataacatgtataaaatgtgtgttaaggaggaattacaacgtactttgatttgaatactagtagaaactggccaggaaaaaggtacatttttctaaaaattaatggatcacttgggaattactgacttgactagaagtatcaaaggatgtttgcatgtgaatgtgggttatgttctttcccaccttgtagcatattcgatgaaagttgagttaactgatagctaaaaatctgttttaacagcatgtaaaaagttattttatctgttaaaagtcattatacagttttgaatgttatgtagtttctttttaacagtttaggtaataaggtctgttttcattctggtgcttttattaattttgatagtatgatgttacttactactgaaatgtaagctagagtgtacactagaatgtaagctccatgagagcaggtaccttgtctgtcttctctgctgtatctattcccaacgcttgatgatggtgcctggcacatagtaggcactcaataaatatttgttgaatgaatgaatgaatgagtactggtggaatactccattagctttactcttcttttagctaagagaacatgagcaaatttgcgcatgacaacttccaggacaggggaaacttgaacactgaagaattgacctcttaagcctaataatgtggtgacaggctgcccacatgcttcttgacttcagatgaaaatctgcttgaaggcaaaacaaataatatttgaaagaaaaatcaaatgccatttttgtcttctaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372957 - DNA, 4135 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372958 - DNA, 4137 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372959 - DNA, 4114 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggattttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372960 - DNA, 4049 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372961 - DNA, 4114 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttatccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372962 - DNA, 4107 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcttaggctttgattggcactttttgatgtatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372963 - DNA, 4113 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagctttttttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372964 - DNA, 3589 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372965 - DNA, 1723 bp, Homo sapiens
ggtccggacgcgtgggtcgacccacgcgtccggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372966 - DNA, 3148 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcacacaaggcacagatagcacatgatgacgaatacgcgcccgtatcccatccaaggactgaggaactgagctgtcagagaagtgtaatatgtacataacttattcgttc

SEQ ID NO: 372967 - DNA, 3559 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttactatataaactgtcttgaaaactagaacatattctcttctcagaaaaagtgtttttccaactgaaaattatttttcaggtcctaaaacctgctaaatgtttttaggaagtacttactgaaacatttttgtaagacatttttggaatgagattgaacatttatataaatttattattcctctttcatttttttgaaacatgcctattatattttagggccagacaccctttaatggccggataagccatagttaacatttagagaaccatttagaagtgatagaactaatggaatttgcaatgccttttggacctctattagtgatataaatatcaagttatttctgacttttaaacaaaactcccaaattcctaacttattgagctatacttaaaaaaaattacaggtttagagagttttttgtttttcttttactgttggaaaactacttcccattttggcaggaagttaacctatttaacaattagagctagcatttcatgtagtctgaaattctaaatggttctctgatttgagggaggttaaacatcaaacaggtttcctctattggccataacatgtataaaatgtgtgttaaggaggaattacaacgtactttgatttgaatactagtagaaactggccaggaaaaaggtacatttttctaaaaattaatggatcacttgggaattactgacttgactagaagtatcaaaggatgtttgcatgtgaatgtgggttatgttctttcccaccttgtagcatattcgatgaaagttgagttaactgatagctaaaaatctgttttaacagcatgtaaaaagttattttatctgttaaaagtcattatacagttttgaatgttatgtagtttctttttaacagtttaggtaataaggtctgttttcattctggtgcttttattaattttgatagtatgatgttacttactactgaaatgtaagctagagtgtacactagaatgtaagctccatgagacaaggtacctgctctcatggtcgacgcggccgcgaatttagtagtagta

SEQ ID NO: 372968 - DNA, 854 bp, Homo sapiens
ggactagttctagatcgcgagcggccgcccttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372969 - DNA, 2446 bp, Homo sapiens
  misc_feature (2408)..(2408): n is a, c, g, or t
  misc_feature (2415)..(2415): n is a, c, g, or t
  misc_feature (2433)..(2433): n is a, c, g, or t
  misc_feature (2443)..(2443): n is a, c, g, or t
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagttgttaccattaatntgtttanccaagaaagaatttattnatcctatttngtt

SEQ ID NO: 372970 - DNA, 2030 bp, Homo sapiens
tgccgaagatgcaccttatgtcaatactgaaatcaggtaacaacgtgttacacgcaaaatgaccagtacaacgttcatatgaccagagatatagtccggcggagagttactattaataaaatctgagcattttctcttttatgatctctagtatataagtatacatctatatttatctgtatatatatgtgcttgctttttgagcatccactccagatagccggcgatatcctctagagctcgcccatgcgtgcgcatgccatgccttgcgctggggcctgacgcccacctcgtcggcgacggggataaccctgggggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgacttttctcatgtgtggttgtggtacatcatattggaagggttaacctgttactttggcaaatgagtatttttttgctagcacctccccttgcgtgctttaaatgacatctgcctgggatgtaccacaaccatatgttacctgtatcttaggggaatggataaaatatttgtggtttactgggtaatccctagatgatgtatgcttgcagtcctatataaaactaaatttgctatctgtgtagaaaataatttcatgacatttacaatcaggactgaagtaagttcttcacacagtgacctctgaatcagtttcagagaagggatgggggagaaaatgccttctaggttttgaacttctatgcattagtgcagatgttgtgaatgtgtaaaggtgttcatagtttgactgtttctatgtatgttttttcaaagaattgttcctttttttgaactataatttttctttttttggttattttaccatcacagtttaaatgtatatcttttatgtctctactcagaccatatttttaaaggggtgcctcattatggggcagagaacttttcaataagtctcattaagatctgaatcttggttctaagcattctgtataatatgtgattgcttgtcctagctgcagaaggccttttgtttggtcaaatgcatattttagcagagtttcaaggaaatgattgtcacacatgtcactgtagcctcttggtgtagcaagctcacatacaaaatacttttgtatatgcataatataaatcatctcatgtggatatgaaacttcttttttaaaacttaaaaaggtagaatgttattgattaccttgattagggcagttttatttccagatcctaataattcctaaaaaatatggaaaagttttttttcaatcattgtaccttgatattaaaacaaatatcctttaagtatttctaatcagttagcttctacagttcttttgtctccttttatatgcagctcttacgtgggagacttttccacttaaaggagacatagaatgtgtgcttattctcagaaggttcattaactgaggtgatgagttaacaactagttgagcagtcagcttcctaagtgttttaggacatttgttcattatattttccgtcatataactagaggaagtggaatgcagataagtgccgaattcaaacccttcattttatgtttaagctcctgaatctgcattccacttgggttgtttttaagcattctaaattttagttgattataagttagatttcacagaatcagtattgcccttgatcttgtcctttttatggagttaacggggaggaagacccctcaggaaaacgaaagtaaattgttaaggctcatcttcatacctttttccattttgaatcctacaaaaatactgcaaaagactagtgaatgtttaaaattacactagattaaataatatgaaagtcaggtt

SEQ ID NO: 372971 - DNA, 1220 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaaacctgactcggacgcggcactgtaccccaggcctctttattactcttccgctgtgggtccggctttttggcctttaggagtgggacatgtgagggtgggggcctgtcgtcaggacttcactgtatggtgcccttctttccgtctctgaggcccgatttctctgacgagggcccaaaatgaagaggtccctgcgcggggggctccgggttcaaccgaccgcctcgtggagttggggcggcctgcgtcctgcagccttggggtctgtccgctcggttaccatgcactcgagacctgtcgagcgtcccctcttcttccgtaggagagaagtgtgtttagaatcttaaggtagaactgcctttccggcaggcccattttgaatgggtcttcgatttgctacccccgcgcccatgcgatgggctcccctgcgtttccctctttgtttcaattgtttaggtgtccccccgagcctcaggctcagctcaatcgcgagatgattttctgcagcgactttttgttcctaggggactgtgaaggggcgggggactgccacgatttagattcgttgggggctgggtcctggggagactggagaggatggctgggactcggggcacatggagagagcgtctaacatggcggcggctgcggggagagggaagcgctttactggagctgcattgtgagcacaaagcgaaagcagagggggagggcagagaccaggcagccgccccgactggcctccttaggcccccctcta

SEQ ID NO: 372972 - DNA, 1244 bp, Homo sapiens
agcgggatctcggcacgctcggtatgtctccttgactggccgtcgttttacaacctcccgatgcttctctctccttggcctgaaatgccctcggcacatccactggaagggattccggaccacgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaaggtgccaggagttggcggggaagggaggggtggctgcggccgggctctgcggcccctccgaccctggtcgctggagccttcgcttcttttcgtctcgggagcgttactaggtcccctcctcccaccccctggcccacacgccccgtctccacgttcagcgggagcttcgtgcccagaaaacgggctcttggaagaggcacttgtcacctgactcggacgcggcactgtaccccaggcctctttattactcttccgctgtgggtccggctttttggcctttaggagtgggacatgtgagggtgggggcctgtcgtcaggacttcactgtatggtgcccttctttccgtctctgaggcccgatttctctgacgagggcccaaaatgaagaggtccctgcgcggggggctccgggttcaaccgaccgcctcgtggagttggggcggcctgcgtcctgcagccttggggtctgtccgctcggttaccatgcactcgagacctgtcgagcgtcccctcttcttccgtaggagagaagtgtgtttagaatcttaaggtagaactgcctttccggcaggcccattttgaatgggtcttcgatttgctacccccgcgcccatgcgatgggctcccctgcgtttccctctttgtttcaattgtttaggtgtccccccgagcctcaggctcagctcaatcgcgagatgattttctgcagcgactttttgttcctaggggactgtgaaggggcgggggactgccacgatttagattcgttgggggctgggtcctggggagactggagaggatggctgggactcggggcacatggagagagcgtctaacatggcggcggctgcggggagagggaagcgctttactggagctgcattgtgagcacaaagcgaaagcagagggggagggcagagaccaggcagccgccccgactggcctccttaggcccccctcta

SEQ ID NO: 372973 - DNA, 606 bp, Homo sapiens
acagaacaaggtgtagctgtgataaactgatactgaagtgtctaaaagattaaggaagaattctgtattgagtgttagactgaaagaatagatgggtaagcattttttaaaaagtaccttttcaatactaactagcttgtcttttagggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttactatataaactgtcttgaaaactagaacatattctcttctcagaaaaagtgtttttccaactgaaaattatttttcaggtcctaaaacctgctaaatgtttttaggaagtacttactgaaacatttttgtaagacatttttggaatgagattgaacatttatataaatttattattcctctttcatttttttgaaa

SEQ ID NO: 372974 - DNA, 1036 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgccggaaaggcgtttgggatgccaacgatgaggctgctgtcatttgtggtgttggctctatttgctgtcactcaagcagaggaaggagccaggcttttggttccaaatcactgctgaacagatacgccgtggagggacgagactgaccttgcagtacaacatctacaatgttggctcaagtgctgcattagaccgtggaactatctgatgattccttcctccagaagactttggcattgtggtctggatggtccatgtcaaatgggaccggattggccctgtagcattgtctccccactgtggtctgcgcctcttcaggctgtttttccacttcccttcggcacattttactggcagaggtggccgtgggttggtctcccaggccctggcgcggggactggccgcggttgacggggtcccctttggggggttggtgcgctccccgggcccgttggtgcccggaatgcccagaagttggggcgccccacaagctcagggccgtg

SEQ ID NO: 372975 - DNA, 5626 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgacttttctcatgtgtggttgtggtacatcatattggaagggttaacctgttactttggcaaatgagtatttttttgctagcacctccccttgcgtgctttaaatgacatctgcctgggatgtaccacaaccatatgttacctgtatcttaggggaatggataaaatatttgtggtttactgggtaatccctagatgatgtatgcttgcagtcctatataaaactaaatttgctatctgtgtagaaaataatttcatgacatttacaatcaggactgaagtaagttcttcacacagtgacctctgaatcagtttcagagaagggatgggggagaaaatgccttctaggttttgaacttctatgcattagtgcagatgttgtgaatgtgtaaaggtgttcatagtttgactgtttctatgtatgttttttcaaagaattgttcctttttttgaactataatttttctttttttggttattttaccatcacagtttaaatgtatatcttttatgtctctactcagaccatatttttaaaggggtgcctcattatggggcagagaacttttcaataagtctcattaagatctgaatcttggttctaagcattctgtataatatgtgattgcttgtcctagctgcagaaggccttttgtttggtcaaatgcatattttagcagagtttcaaggaaatgattgtcacacatgtcactgtagcctcttggtgtagcaagctcacatacaaaatacttttgtatatgcataatataaatcatctcatgtggatatgaaacttcttttttaaaacttaaaaaggtagaatgttattgattaccttgattagggcagttttatttccagatcctaataattcctaaaaaatatggaaaagttttttttcaatcattgtaccttgatattaaaacaaatatcctttaagtatttctaatcagttagcttctacagttcttttgtctccttttatatgcagctcttacgtgggagacttttccacttaaaggagacatagaatgtgtgcttattctcagaaggttcattaactgaggtgatgagttaacaactagttgagcagtcagcttcctaagtgttttaggacatttgttcattatattttccgtcatataactagaggaagtggaatgcagataagtgccgaattcaaacccttcattttatgtttaagctcctgaatctgcattccacttgggttgtttttaagcattctaaattttagttgattataagttagatttcacagaatcagtattgcccttgatcttgtcctttttatggagttaacggggaggaagacccctcaggaaaacgaaagtaaattgttaaggctcatcttcatacctttttccattttgaatcctacaaaaatactgcaaaagactagtgaatgtttaaaattacactagattaaataatatgaaagtcaggtt

SEQ ID NO: 372976 - DNA, 3987 bp, Homo sapiens
agcgggatctcggcacgctcggtatgtctccttgactggccgtcgttttacaacctcccgatgcttctctctccttggcctgaaatgccctcggcacatccactggaagggattccggaccacgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372977 - DNA, 4580 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgacttttctcatgtgtggttgtggtacatcatattggaagggttaacctgttactttggcaaatgagtatttttttgctagcacctccccttgcgtgctttaaatgacatctgcctgggatgtaccacaaccatatgttacctgtatcttaggggaatggataaaatatttgtggtttactgggtaatccctagatgatgtatgcttgcagtcctatataaaactaaatttgctatctgtgtagaaaacaaaaccacaaaaaaaattttttgggcggctttgggccctgaaaaatttttaaaacccttttgtttggggccggggccccaaatgggtatgggaaccatgggcacaaagggtgtcccacagagaaaacccggcgctaacatagggctgggttttcccccaatataaaaagc

SEQ ID NO: 372978 - DNA, 3966 bp, Homo sapiens
cggacgacttgctgccgctcccgctgtggctggtggccgagggcatcgtgcgcgcgcggaggccgctggaaatcacgagtgggcagctgagggggcaagggtggcggtcccttccgggcagtgtcgcgcgctccgtgggcgcaggccgcttcgccctgtcccgctgcaccgagagccgctcctagtgaggcgagagccgggagcgggagggacttagccagccagcagccctctgggtcgcgaggggcgggagaagcaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372979 - DNA, 4069 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagttttggggaggaacggggacctctagagtgacctca

SEQ ID NO: 372980 - DNA, 5709 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttactatataaactgtcttgaaaactagaacatattctcttctcagaaaaagtgtttttccaactgaaaattatttttcaggtcctaaaacctgctaaatgtttttaggaagtacttactgaaacatttttgtaagacatttttggaatgagattgaacatttatataaatttattattcctctttcatttttttgaaacatgcctattatattttagggccagacaccctttaatggccggataagccatagttaacatttagagaaccatttagaagtgatagaactaatggaatttgcaatgccttttggacctctattagtgatataaatatcaagttatttctgacttttaaacaaaactcccaaattcctaacttattgagctatacttaaaaaaaattacaggtttagagagttttttgtttttcttttactgttggaaaactacttcccattttggcaggaagttaacctatttaacaattagagctagcatttcatgtagtctgaaattctaaatggttctctgatttgagggaggttaaacatcaaacaggtttcctctattggccataacatgtataaaatgtgtgttaaggaggaattacaacgtactttgatttgaatactagtagaaactggccaggaaaaaggtacatttttctaaaaattaatggatcacttgggaattactgacttgactagaagtatcaaaggatgtttgcatgtgaatgtgggttatgttctttcccaccttgtagcatattcgatgaaagttgagttaactgatagctaaaaatctgttttaacagcatgtaaaaagttattttatctgttaaaagtcattatacagttttgaatgttatgtagtttctttttaacagtttaggtaataaggtctgttttcattctggtgcttttattaattttgatagtatgatgttacttactactgaaatgtaagctagagtgtacactagaatgtaagctccatgagagcaggtaccttgtctgtcttctctgctgtatctattcccaacgcttgatgatggtgcctggcacatagtaggcactcaataaatatttgttgaatgaatgaatgaatgagtactggtggaatactccattagctttactcttcttttagctaagagaacatgagcaaatttgcgcatgacaacttccaggacaggggaaacttgaacactgaagaattgacctcttaagcctaataatgtggtgacaggctgcccacatgcttcttgacttcagatgaaaatctgcttgaaggcaaaacaaataatatttgaaagaaaaatcaaatgccatttttgtcttctaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372981 - DNA, 4073 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372982 - DNA, 3915 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaactttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372983 - DNA, 3075 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaagggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372984 - DNA, 3607 bp, Homo sapiens
  misc_feature (3547)..(3547): n is a, c, g, or t
  misc_feature (3553)..(3553): n is a, c, g, or t
  misc_feature (3562)..(3562): n is a, c, g, or t
  misc_feature (3578)..(3579): n is a, c, g, or t
  misc_feature (3582)..(3582): n is a, c, g, or t
  misc_feature (3586)..(3586): n is a, c, g, or t
  misc_feature (3596)..(3596): n is a, c, g, or t
  misc_feature (3601)..(3601): n is a, c, g, or t
  misc_feature (3604)..(3604): n is a, c, g, or t
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaaaaaaaaaaaaaaaaaaaaaaaaaaaaaaaaanaaaaanaaaaaaaanaaaaaaaaaaaaaaannaanaaanaaaaaaaaanaaaanaanaga

SEQ ID NO: 372985 - DNA, 3538 bp, Homo sapiens
  misc_feature (3481)..(3482): n is a, c, g, or t
  misc_feature (3487)..(3487): n is a, c, g, or t
  misc_feature (3511)..(3511): n is a, c, g, or t
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttcctnngactnggtagtataacgcccgcaccatanaataaaaagctgtatatttaagtttgc

SEQ ID NO: 372986 - DNA, 3611 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttactatataaactgtcttgaaaactagaacatattctcttctcagaaaaagtgtttttccaactgaaaattatttttcaggtcctaaaacctgctaaatgtttttaggaagtacttactgaaacatttttgtaagacatttttggaatgagattgaacatttatataaatttattattcctctttcatttttttgaaacatgcctattatattttagggccagacaccctttaatggccggataagccatagttaacatttagagaaccatttagaagtgatagaactaatggaatttgcaatgccttttggacctctattagtgatataaatatcaagttatttctgacttttaaacaaaactcccaaattcctaacttattgagctatacttaaaaaaaattacaggtttagagagttttttgtttttcttttactgttggaaaactacttcccattttggcaggaagttaacctatttaacaattagagctagcatttcatgtagtctgaaattctaaatggttctctgatttgagggaggttaaacatcaaacaggtttcctctattggccataacatgtataaaatgtgtgttaaggaggaattacaacgtactttgatttgaatactagtagaaactggccaggaaaaaggtacatttttctaaaaattaatggatcacttgggaattactgacttgactagaagtatcaaaggatgtttgcatgtgaatgtgggttatgttctttcccaccttgtagcatattcgatgaaagttgagttaactgatagctaaaaatctgttttaacagcatgtaaaaagttattttatctgttaaaagtcattatacagttttgaatgttatgtagtttctttttaacagtttaggtaataaggtctgttttcattctggtgcttttattaattttgatagtatgatgttacttactactgaaatgtaagctagagtgtacactagaatgtaagctccatgagagcaggtaccttgtctgtcttctctgctgtatctattcccaacgcttgatgatggtgcctggcacatagtaggcactcaataaatatttgttgaatgaatga

SEQ ID NO: 372987 - DNA, 2629 bp, Homo sapiens
  misc_feature (2569)..(2569): n is a, c, g, or t
  misc_feature (2575)..(2575): n is a, c, g, or t
  misc_feature (2584)..(2584): n is a, c, g, or t
  misc_feature (2600)..(2601): n is a, c, g, or t
  misc_feature (2604)..(2604): n is a, c, g, or t
  misc_feature (2608)..(2608): n is a, c, g, or t
  misc_feature (2618)..(2618): n is a, c, g, or t
  misc_feature (2623)..(2623): n is a, c, g, or t
  misc_feature (2626)..(2626): n is a, c, g, or t
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcaaaaaaaaaaaaaaaaaaaaaaaaaaaaaaaaaaaanaaaaanaaaaaaaanaaaaaaaaaaaaaaannaanaaanaaaaaaaaanaaaanaanaga

SEQ ID NO: 372988 - DNA, 1493 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgactttt

SEQ ID NO: 372989 - DNA, 1435 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatactaagggctcccggagggttaagggctcccggagggttaagggctcccggagggttaagggctcccag

SEQ ID NO: 372990 - DNA, 1425 bp, Homo sapiens
cgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaaggtgccaggagttggcggggaagggaggggtggctgcggccgggctctgcggcccctccgaccctggtcgctggagccttcgcttcttttcgtctcgggagcgttactaggtcccctcctcccaccccctggcccacacgccccgtctccacgttcagcgggagcttcgtgcccagaaaacgggctcttggaagaggcacttgtcacctgactcggacgcggcactgtaccccaggcctctttattactcttccgctgtgggtccggctttttggcctttaggagtgggacatgtgagggtgggggcctgtcgtcaggacttcactgtatggtgcccttctttccgtctctgaggcccgatttctctgacgagggcccaaaatgaagaggtccctgcgcggggggctccgggttcaaccgaccgcctcgtggagttggggcggcctgcgtcctgcagccttggggtctgtccgctcggttaccatgcactcgagacctgtcgagcgtcccctcttcttccgtaggagagaagtgtgtttagaatcttaaggtagaactgcctttccggcaggcccattttgaatgggtcttcgatttgctacccccgcgcccatgcgatgggctcccctgcgtttccctctttgtttcaattgtttaggtgtccccccgagcctcaggctcagctcaatcgcgagatgattttctgcagcgactttttgttcctaggggactgtgaaggggcgggggactgccacgatttagattcgttgggggctgggtcctggggagactggagaggatggctgggactcggggcacatggagagagcgtctaacatggcggcggctgcggggagagggaagcgctttactggagctgcattgtgagcacaaagcgaaagcagagggggagggcagagaccaggcagccgccccgactggcctccttaggcccccctcta

SEQ ID NO: 372991 - DNA, 434 bp, Homo sapiens
cagagatctgtcaggtgtgcccacacaacagaagcacttgtaaactaattaagcacggtcactgaatccttttttcaccagccttctaaagatgttgtcttaaaaacataagaaagaaaatccatttttttaaagcaatgaaatgttctaattaggtttgaggacatttgaaggagcgattgttttttccccaaaattttggagcagaggggacgttttacatcatcctaacttcatgttcctctgtcattttattttatttatttatttttaattccaaaggagaaagttgaatcaggaaaatttgtcttaaaatatactgcttagtttagagacggacaaactaatgtatttttgtaaatcatgggtggcggatgtcaaaatctctcattaattaccctgtttttttctttaaggaaattgattcatgaata

SEQ ID NO: 372992 - DNA, 367 bp, Homo sapiens
tttgatcactaggcattgtttggttgacctttcaaacctgacccaggatggcccacagcttcttgctgagacattagacattttcttgttgaatttttccctcaaggtagatcttccaagcatccatgttgacatagaatgttctagtttccaatttacactagcttacacccatgatgagattgaaaaccgtaacacatcatctttctttttctataccatttacttagcttgaaatgcttccaactttctctccctcaactaaccgaacctccttctcccttattccttgtgtgcgtttctactcctagaccaatggctctcaaccaggttggtcattggattcatctggctcacttccttaaag

SEQ ID NO: 372993 - DNA, 1188 bp, Homo sapiens
  misc_feature (1157)..(1157): n is a, c, g, or t
gccgccgccgccgcttcagtggccgcagtggccgcaaggacccggacctcagggaggcctccgcacgaagtcggaccgtcctgcgcgccgcctaagtccaggcttgcccgtctgctgccaggcaacaacgcccctagtctctccgttcgggaagacgcgtggccctgcctgccacccaccggaagtgagggcaaatggcaacagcggctctggaattctatacaggcattgctgaggacacctaagatgacgcaatctccgcgcgggtagggcggggctccgcaaggacctcatgccttagagatcgcctgaagagcggaagccttctgtcgagaagcagctacccaagctccaggagcttccgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtgggccgcatcatcgagtgcacacactgtggctgtcgtggctgctctggctgaggctggcgcgctccaccctggactctggacttcgcaggttcctgcctgtcacgccacccccttcctgggagcagcgagcagtgccccaggcccgagttggagcacggtctctatggggaaggcttcgctgtctatcagctgtgatttgtaaaaataaaatctttaaatctctcgaaaaaaaaaacaaacacanaaaacaccaagggaaaaaaacgggggggaaa

SEQ ID NO: 372994 - DNA, 1680 bp, Homo sapiens
gccgccgccgccgcttcagtggccgcagtggccgcaaggacccggacctcagggaggcctccgcacgaagtcggaccgtcctgcgcgccgcctaagtccaggcttgcccgtctgctgccaggcaacaacgcccctagtctctccgttcgggaagacgcgtggccctgcctgccacccaccggaagtgagggcaaatggcaacagcggctctggaattctatacaggcattgctgaggacacctaagatgacgcaatctccgcgcgggtagggcggggctccgcaaggacctcatgccttagagatcgcctgaagagcggaagccttctgtcgagaagcagctacccaagctccaggagcttccggtatgtgttttccctctgttctcgattaccttggcaacggctgaggcgggagaccggtggtctgcaccgtcctggagggagatatgagtggctggactctcagccagccactgggatgtgttcgggctttggaccttgaggccggagagagctcccgagaggaggcggcgccacgttcgttcttctgaggggacggtagatttgggggttttcctctaggattctcgcgccgtttcctctgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtggtaatgtctgacactcaagcttggtgttgttttcagctcaaaattctgccttagtcgactgcaagggatcttatgttatttggttgggctggaatgtcgttttgtccctggatgtcctgctggctctccctcgtgggagtgggtccctgtattcaggaatccatgtgaggcagcgtgtggctgtgtgttagttaggtctggggtcaatctcaactccacttttgggcaaattactgaacccctttcctcacttaggaaatggtggtggggagccctaatcccaaggtggtggcagggtgacatcagggaaggacaaccagtgagttcctgtccctttcagtcctcacagtgatactttaacattaccatcactatctttcccgcccccccaagacggagtcttgctttgtcgcccaggctggagtgcagtgatgccatcttggctcactgcaacctccacctcccgggttcaagcggttctcctgcctcatcctcctgagtagctgggactacaggcatgcaccac

SEQ ID NO: 372995 - DNA, 1003 bp, Homo sapiens
  misc_feature (915)..(915): n is a, c, g, or t
  misc_feature (922)..(922): n is a, c, g, or t
gccgccgccgccgcttcagtggccgcagtggccgcaaggacccggacctcagggaggcctccgcacgaagtcggaccgtcctgcgcgccgcctaagtccaggcttgcccgtctgctgccaggcaacaacgcccctagtctctccgttcgggaagacgcgtggccctgcctgccacccaccggaagtgagggcaaatggcaacagcggctctggaattctatacaggcattgctgaggacacctaagatgacgcaatctccgcgcgggtagggcggggctccgcaaggacctcatgccttagagatcgcctgaagagcggaagccttctgtcgagaagcagctacccaagctccaggagcttccgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtggnccgcatnatcgagtgcacactgtcgtttgagcggttgctttggttggatctgatcttttcactttggctttgtactctgcattcttct

SEQ ID NO: 372996 - DNA, 780 bp, Homo sapiens
ctatgaagaaactttaccactcaggctggaggtgccagacatgcgactatatataaatagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtgggccgcatcatcgagtgcacacactgtggctgtcgtggctgctctggctgaggctggcgcgctccaccctggactctggacttcgcaggttcctgcctgtcacgccacccccttcctgggagcagcgagcagtgccccaggcccgagttggagcacggtctctatggggaaggcttcgctgtctatcagctgtgatttgtaaaaataaaatctttaaatctctcga

SEQ ID NO: 372997 - DNA, 1808 bp, Homo sapiens
gccgccgccgccgcttcagtggccgcagtggccgcaaggacccggacctcagggaggcctccgcacgaagtcggaccgtcctgcgcgccgcctaagtccaggcttgcccgtctgctgccaggcaacaacgcccctagtctctccgttcgggaagacgcgtggccctgcctgccacccaccggaagtgagggcaaatggcaacagcggctctggaattctatacaggcattgctgaggacacctaagatgacgcaatctccgcgcgggtagggcggggctccgcaaggacctcatgccttagagatcgcctgaagagcggaagccttctgtcgagaagcagctacccaagctccaggagcttccggtatgtgttttccctctgttctcgattaccttggcaacggctgaggcgggagaccggtggtctgcaccgtcctggagggagatatgagtggctggactctcagccagccactgggatgtgttcgggctttggaccttgaggccggagagagctcccgagaggaggcggcgccacgttcgttcttctgaggggacggtagatttgggggttttcctctaggattctcgcgccgtttcctctgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtgggccgcatcatcgagtgcacacactgtggctgtcgtggctgctctggctgaggctggcgcgctccaccctggactctggacttcgcaggttcctgcctgtcacgccacccccttcctgggagcagcgagcagtgccccaggcccgagttggagcacggtctctatggggaaggcttcgctgtctatcagctgtgatttgtaaaaataaaatctttaaatctctcgagccccacgtctcttctttcagagcatcggcctatggaacccggcggggcggcccaggccccagggaccagatgccccagcccccttgtggtgtgtgaggtgacacacaaaggtagctggagctggaagtcccgtgaaggtgacacgcaaaggtggctggagctgcacttggacctgctgggagcacaggcaccttgggcctagtgtgtgtcctcaccaacacctgtgacacgctgcggctgttcctcagggcctggctcttcccccaggcaggaggtgacaccagctcacttgtcctggggctcccacagagcactgggggccgagcacattgttccagctgtgctcccatcacctgcccccaagggcacatccgtcatcagcctccttgccggtgtcctggtccccctggggcttggtccggaactt

SEQ ID NO: 372998 - DNA, 1211 bp, Homo sapiens
gccgccgccgccgcttcagtggccgcagtggccgcaaggacccggacctcagggaggcctccgcacgaagtcggaccgtcctgcgcgccgcctaagtccaggcttgcccgtctgctgccaggcaacaacgcccctagtctctccgttcgggaagacgcgtggccctgcctgccacccaccggaagtgagggcaaatggcaacagcggctctggaattctatacaggcattgctgaggacacctaagatgacgcaatctccgcgcgggtagggcggggctccgcaaggacctcatgccttagagatcgcctgaagagcggaagccttctgtcgagaagcagctacccaagctccaggagcttccggtatgtgttttccctctgttctcgattaccttggcaacggctgaggcgggagaccggtggtctgcaccgtcctggagggagatatgagtggctggactctcagccagccactgggatgtgttcgggctttggaccttgaggccggagagagctcccgagaggaggcggcgccacgttcgttcttctgaggggacggtagatttgggggttttcctctaggattctcgcgccgtttcctctgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcagacaaaaacctgattgcaaaatggaaaaagcaaggatatgagaacttgtgctgcctgcggtgcattcagacacgggacaccaacttcgggaacaaaattgaattttgccggggtgccccaaaaagcaaagcctgggaaagttggggcccgctattatatggaggtggcccccaccccttgtgggtttgt

SEQ ID NO: 372999 - DNA, 1497 bp, Homo sapiens
gccgccgccgccgcttcagtggccgcagtggccgcaaggacccggacctcagggaggcctccgcacgaagtcggaccgtcctgcgcgccgcctaagtccaggcttgcccgtctgctgccaggcaacaacgcccctagtctctccgttcgggaagacgcgtggccctgcctgccacccaccggaagtgagggcaaatggcaacagcggctctggaattctatacaggcattgctgaggacacctaagatgacgcaatctccgcgcgggtagggcggggctccgcaaggacctcatgccttagagatcgcctgaagagcggaagccttctgtcgagaagcagctacccaagctccaggagcttccggtatgtgttttccctctgttctcgattaccttggcaacggctgaggcgggagaccggtggtctgcaccgtcctggagggagatatgagtggctggactctcagccagccactgggatgtgttcgggctttggaccttgaggccggagagagctcccgagaggaggcggcgccacgttcgttcttctgaggggacggtagatttgggggttttcctctaggattctcgcgccgtttcctctgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagaggtaattagtcagtctctcttggactttgaagctcgcgtcacttttggagttactgaactaaccacaatccttattctcgcaacctgtgcaagtcatggtttttcttaccacgaaaattagggggagccaacgttggctgagttttgtgtgtgtgtttgttttttgtttgtttgttttgagatggagtctcactctgtcacccaggctggagtgcagtggcgcaatcttggctcactgcaagctccacttcctgggttcaagcgattctcctgtctcagctcccaagtagctgggattacaggcacctgccaccacacctggccaatttttgtatttttagtaaagatggggtttcaccatattggtcaggctgatcttgaactcctgacctcaggtgattcacccgactcggtctcccaaagtgctggaattataggcgtggtccaccgctcttggctttttttttttttttttttttgaaacagggtcttgctctgttccacaggctgg

SEQ ID NO: 373000 - DNA, 1243 bp, Homo sapiens
gccgccgccgccgcttcagtggccgcagtggccgcaaggacccggacctcagggaggcctccgcacgaagtcggaccgtcctgcgcgccgcctaagtccaggcttgcccgtctgctgccaggcaacaacgcccctagtctctccgttcgggaagacgcgtggccctgcctgccacccaccggaagtgagggcaaatggcaacagcggctctggaattctatacaggcattgctgaggacacctaagatgacgcaatctccgcgcgggtagggcggggctccgcaaggacctcatgccttagagatcgcctgaagagcggaagccttctgtcgagaagcagctacccaagctccaggagcttccggtatgtgttttccctctgttctcgattaccttggcaacggctgaggcgggagaccggtggtctgcaccgtcctggagggagatatgagtggctggactctcagccagccactgggatgtgttcgggctttggaccttgaggccggagagagctcccgagaggaggcggcgccacgttcgttcttctgaggggacggtagatttgggggttttcctctaggattctcgcgccgtttcctctgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatcaagagtcatgactcttacagtgggtaggattactcccttttttgttgtcattaaggaaaccttttgtcaattttggcttttgttgccatttcttttggtgttttagtcatgaagtctttgcccatgcttatgtcctcaatggtattgcctaggttttcttctaggatttttctggttttaggtctcacgtttaaatctttaatgcatcttgagttaatttttgtataaggtgtcagcaaggggtctagtttcggttttctgcactatgaccagccagagtgcacaggcgacccgcaagcttcttcctgtgcctgtggaatctagctaccgtcctagtcc

SEQ ID NO: 373001 - DNA, 1139 bp, Homo sapiens
gccgccgccgccgcttcagtggccgcagtggccgcaaggacccggacctcagggaggcctccgcacgaagtcggaccgtcctgcgcgccgcctaagtccaggcttgcccgtctgctgccaggcaacaacgcccctagtctctccgttcgggaagacgcgtggccctgcctgccacccaccggaagtgagggcaaatggcaacagcggctctggaattctatacaggcattgctgaggacacctaagatgacgcaatctccgcgcgggtagggcggggctccgcaaggacctcatgccttagagatcgcctgaagagcggaagccttctgtcgagaagcagctacccaagctccaggagcttccgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtgggccgcatcatcgagtgcacacactgtggctgtcgtggctgctctggctgaggctggcgcgctccaccctggactctggacttcgcaggttcctgcctgtcacgccacccccttcctgggagcagcgagcagtgccccaggcccgagttggagcacggtctctatggggaaggcttcgctgtctatcagctgtgatttgtaaaaataaaatctttaaatctctcga

SEQ ID NO: 373002 - DNA, 1380 bp, Homo sapiens
gccgccgccgccgcttcagtggccgcagtggccgcaaggacccggacctcagggaggcctccgcacgaagtcggaccgtcctgcgcgccgcctaagtccaggcttgcccgtctgctgccaggcaacaacgcccctagtctctccgttcgggaagacgcgtggccctgcctgccacccaccggaagtgagggcaaatggcaacagcggctctggaattctatacaggcattgctgaggacacctaagatgacgcaatctccgcgcgggtagggcggggctccgcaaggacctcatgccttagagatcgcctgaagagcggaagccttctgtcgagaagcagctacccaagctccaggagcttccggtatgtgttttccctctgttctcgattaccttggcaacggctgaggcgggagaccggtggtctgcaccgtcctggagggagatatgagtggctggactctcagccagccactgggatgtgttcgggctttggaccttgaggccggagagagctcccgagaggaggcggcgccacgttcgttcttctgaggggacggtagatttgggggttttcctctaggattctcgcgccgtttcctctgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtgggccgcatcatcgagtgcacacactgtggctgtcgtggctgctctggctgaggctggcgcgctccaccctggactctggacttcgcaggttcctgcctgtcacgccacccccttcctgggagcagcgagcagtgccccaggcccgagttggagcacggtctctatggggaaggcttcgctgtctatcagctgtgatttgtaaaaataaaatctttaaatctctcga

SEQ ID NO: 373003 - DNA, 1429 bp, Homo sapiens
  misc_feature (1398)..(1398): n is a, c, g, or t
gccgccgccgccgcttcagtggccgcagtggccgcaaggacccggacctcagggaggcctccgcacgaagtcggaccgtcctgcgcgccgcctaagtccaggcttgcccgtctgctgccaggcaacaacgcccctagtctctccgttcgggaagacgcgtggccctgcctgccacccaccggaagtgagggcaaatggcaacagcggctctggaattctatacaggcattgctgaggacacctaagatgacgcaatctccgcgcgggtagggcggggctccgcaaggacctcatgccttagagatcgcctgaagagcggaagccttctgtcgagaagcagctacccaagctccaggagcttccggtatgtgttttccctctgttctcgattaccttggcaacggctgaggcgggagaccggtggtctgcaccgtcctggagggagatatgagtggctggactctcagccagccactgggatgtgttcgggctttggaccttgaggccggagagagctcccgagaggaggcggcgccacgttcgttcttctgaggggacggtagatttgggggttttcctctaggattctcgcgccgtttcctctgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtgggccgcatcatcgagtgcacacactgtggctgtcgtggctgctctggctgaggctggcgcgctccaccctggactctggacttcgcaggttcctgcctgtcacgccacccccttcctgggagcagcgagcagtgccccaggcccgagttggagcacggtctctatggggaaggcttcgctgtctatcagctgtgatttgtaaaaataaaatctttaaatctctcgaaaaaaaaaacaaacacanaaaacaccaagggaaaaaaacgggggggaaa

SEQ ID NO: 373004 - DNA, 604 bp, Homo sapiens
gggtttctccatgttggccaggctggtctcgaactcctggcctcaagtgatccacccacctcggcctcccaaagtgatgggattacagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtgggccgcatcatcgagtgcacacactgtggctgtcgtggctgctctggctgaggctggcgcgctccaccctggactctggacttcgcaggttcctgcctgtcacgccacccccttcctgggagcagcgagcagtgccccaggcccgagttggagcacggtctctatggggaaggcttcgctgtctatcagctgtgatttgtaaaaataaaatctttaaatctctcga

SEQ ID NO: 373005 - DNA, 2811 bp, Homo sapiens
  misc_feature (722)..(722): n is a, c, g, or t
  misc_feature (1587)..(1587): n is a, c, g, or t
  misc_feature (1790)..(1790): n is a, c, g, or t
  misc_feature (2317)..(2317): n is a, c, g, or t
  misc_feature (2805)..(2805): n is a, c, g, or t
  misc_feature (2807)..(2807): n is a, c, g, or t
  misc_feature (2809)..(2810): n is a, c, g, or t
acaataactagaaagaattggatttctctttctactctggcaggaccaaaaaaaaaattttgtaacaaaccagtaggttaatgtggttttgttttgtttcggttttggtcagcttcatttagcctatgatgggtcatggctttgaaacttttgtctagcacttagtcaggctgatgaggcaggatgacttataaaggtgggtgtaagaagagcccttggattacagagaactgtagtaggtaggagagatgctagacaattcactacttaatcgtcagtcttcattaatccctggggggagtagcctctatgtttcaggcagctctggacagttagtgtttgtgcacatacccagtgatttgttgatgagactctgtgggcaacaaccacagtcattgtatatgcaaccttgtgcctactggcctaatttgcttgttacctgaaactgtgtcgaaactaaagtttccagaaattgagtcgaaatgtttacaaaatgtgacatgacagtgctctctggcctgaatgtgcatttacttgccttagtttattctttatcttagtaatttacttcgtatggtttggtctctgataactttcacagattctggttaacacgagttactaaaatttgtgaaataatagtatcacattgtgtttcttggtacacatttgaagtcagtcaaaacaatgtttgagaatgtgtctggctctttaatgccctntgcagcagaggactttgtaaaggatttcatttcaatcctaaatgacctgtgagaatctggtctcaggtaaaaatctagttacattttgagccactacctaatttaattatctttggatatacttgtttgcataaacatttaatatctgattgcataggtaatatgacattaccctctctatcccaattcctaccctctctcttgacacccagaagtttctgcagttggatttcctgtttcattgcaaggcagtattggagcctgcattcctagcagctgagaatagaaataacaaataattattattaatttaataattgttaatagtgtaaatagttcattgttcctacagactgcattttgagaactggtattcctaatgtatttcatatattaaaaatgaagtcaagcgttttagatttaggcaggtagcacttagagaaaggatctcacaatctctgctcctctttgcacaagtctagcaaaagtgaaactatgtttatagcttcagctttgatacaaacacttttctcaaacagattctagacccatgggaaaaggcttctttccttgtgctccttgagaacactgtgtaaagaacgtactaatgaaagaatctaaggtcaagaagaatgaatgcacctttaaaatgacaagttttatcttgttactctcctgctaaaaacagtctgttgcattctatgagatggtatggatggtgtccagatgcctcactaggccacactcagggtccttgaatagctgcagtttgccaggcttttctgcattgtcgtggtggtccttcccttgttgctgctgcctgagagatactgcctggttcttacagacacagattatgtcatcnttgcagccttcacccaaagttgctccctccttctagggcattttgttttcctacttaataccaagtgtcagcatgttagtaataaacaggtgtctctaccattagtcaaaggtgggagttaagcctttcatctttgtagctttctccagtacctaaccatgatttacttcatgggaagtccctcaaagtactattaattatcntgtgttctcctgccttgcctcttaacaaaaattctgctgttcctgattatttccattttaccagtgttttgttccttttctatccaggcagcataattcgttgtatgaggcgcctggaagaattgcttcgacaaatgtgtcaagcagcaaaagccattggaaacactgagctggaaaataaatttgcagaaggaaggtcagtatcaaatggataagctgtttctaatttagacaaatttggtgaagcaaatcttgagccctggaccacaacctaggaggacgttttgagatgttcttcactgcattgtcatggagagctatctactagtgtttctataaaatttagtgtgttgggggaaaagttgagattttatatatacatgcatttacgtatattaattgtacgctaactacatgccaggcattgttttaagcactaggggatatagtgaacaaaaagacacccctgccttcatggagtttacattctagtgtggggagatagacaataagtcaacaattaaatntatcagatggtgataagtctgtaagataaaaacaaagcagaaaagacaatagaattggcagatggatatgatggtctagggcctccacagggaaggtggcagttaaggcctttggtgtatgcttgatgtacgtgaacaccagcaagaggccagtgtggctggagcagaatgggcagtgagtagaggagtaggggttgaagtgagaaaggaaatgattccatagttcccagccccaggcttctcaactctgcagtgactggaggtgtggagtttgggagtgacctgccccaacttggactttacaaggtaattgttgctcttacattcagggcaagtctgtagagtagcacagtagaagtggggagaacagatcaagaaaggatggctaaaccaaggtggtagtaatggagtggtggtgggggggcaaggggcataagcttcagtcctgtctactgactcttgaccaagaaaaaggactaagttaatcnangnnt

SEQ ID NO: 373006 - DNA, 4083 bp, Homo sapiens
agggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttctacatgtgaattagttttttcaagtcataatcccctaaaaaaactatttctagccagagcctttcacaataaaaatactaagattttacaaaactactaagttttagaaagagcaaccta

SEQ ID NO: 373007 - DNA, 3907 bp, Homo sapiens
agggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcaactaatattgcaaccagagctccctgaatgagtccagtcaacacatcgctccagtggtgtttataatcagaaactcgagaaaggcccacataaatggatacggcaacaagaccaaattgcagtgtggggcgtaagagtcttgcccagtctcccttcatcctggcttgaagataaagctaaaagaaa

SEQ ID NO: 373008 - DNA, 3960 bp, Homo sapiens
agggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagaccagcccccccccctccacgagcactgcgcgcgaagaagggcgcgtgcacccccgcgcccaagaacttgggtccggtaaggagtgccattagtcttag

SEQ ID NO: 373009 - DNA, 3789 bp, Homo sapiens
agggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttcta

SEQ ID NO: 373010 - DNA, 3852 bp, Homo sapiens
agggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtaaggatccatgcaggtctggtcttgaactcctggcctcaagcaattctcctgcttcaccctactgagtagctgggattaaaggtgggaatcatcacatgcagcatcaaaattcaggattttgacaggatcccctgaatataaacctatcccatttcaattcatttcttgtcctcgtacttccctggtgtttcagtctgcat

SEQ ID NO: 373011 - DNA, 3924 bp, Homo sapiens
agggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcagtcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttcta

SEQ ID NO: 373012 - DNA, 3801 bp, Homo sapiens
agggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttcta

SEQ ID NO: 373013 - DNA, 4606 bp, Homo sapiens
  misc_feature (3440)..(3440): n is a, c, g, or t
agggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaaggtcagtatcaaatggataagctgtttctaatttagacaaatttggtgaagcaaatcttgagccctggaccacaacctaggaggacgttttgagatgttcttcactgcattgtcatggagagctatctactagtgtttctataaaatttagtgtgttgggggaaaagttgagattttatatatacatgcatttacgtatattaattgtacgctaactacatgccaggcattgttttaagcactaggggatatagtgaacaaaaagacacccctgccttcatggagtttacattctagtgtggggagatagacaataagtcaacaattaaatntatcagatggtgataagtctgtaagataaaaacaaagcagaaaagacaatagaattggcagatggatatgatggtctagggcctccacagggaaggtggcagttaaggcctttggtgtatgcttgatgtacgtgaacaccagcaagaggccagtgtggctggagcagaatgggcagtgagtagaggagtaggggttgaagtgagaaaggaaatgattccatagttcccagccccaggcttctcaactctgcagtgactggaggtgtggagtttgggagtgacctgccccaacttggactttacaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttcta

SEQ ID NO: 373014 - DNA, 3948 bp, Homo sapiens
agggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttcta

SEQ ID NO: 373015 - DNA, 1606 bp, Homo sapiens
tcagctgcgtgctgcggttatctcggtcgcgttcgcgctccttgccttgtgttggcatcagtcaggctgaaagtcatcagagtagagcttgagctcgatgtatctctcctccatgtcaattgaactgtgtatacgcttgtgaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttcta

SEQ ID NO: 373016 - DNA, 2842 bp, Homo sapiens
  misc_feature (722)..(722): n is a, c, g, or t
  misc_feature (1587)..(1587): n is a, c, g, or t
  misc_feature (1790)..(1790): n is a, c, g, or t
acaataactagaaagaattggatttctctttctactctggcaggaccaaaaaaaaaattttgtaacaaaccagtaggttaatgtggttttgttttgtttcggttttggtcagcttcatttagcctatgatgggtcatggctttgaaacttttgtctagcacttagtcaggctgatgaggcaggatgacttataaaggtgggtgtaagaagagcccttggattacagagaactgtagtaggtaggagagatgctagacaattcactacttaatcgtcagtcttcattaatccctggggggagtagcctctatgtttcaggcagctctggacagttagtgtttgtgcacatacccagtgatttgttgatgagactctgtgggcaacaaccacagtcattgtatatgcaaccttgtgcctactggcctaatttgcttgttacctgaaactgtgtcgaaactaaagtttccagaaattgagtcgaaatgtttacaaaatgtgacatgacagtgctctctggcctgaatgtgcatttacttgccttagtttattctttatcttagtaatttacttcgtatggtttggtctctgataactttcacagattctggttaacacgagttactaaaatttgtgaaataatagtatcacattgtgtttcttggtacacatttgaagtcagtcaaaacaatgtttgagaatgtgtctggctctttaatgccctntgcagcagaggactttgtaaaggatttcatttcaatcctaaatgacctgtgagaatctggtctcaggtaaaaatctagttacattttgagccactacctaatttaattatctttggatatacttgtttgcataaacatttaatatctgattgcataggtaatatgacattaccctctctatcccaattcctaccctctctcttgacacccagaagtttctgcagttggatttcctgtttcattgcaaggcagtattggagcctgcattcctagcagctgagaatagaaataacaaataattattattaatttaataattgttaatagtgtaaatagttcattgttcctacagactgcattttgagaactggtattcctaatgtatttcatatattaaaaatgaagtcaagcgttttagatttaggcaggtagcacttagagaaaggatctcacaatctctgctcctctttgcacaagtctagcaaaagtgaaactatgtttatagcttcagctttgatacaaacacttttctcaaacagattctagacccatgggaaaaggcttctttccttgtgctccttgagaacactgtgtaaagaacgtactaatgaaagaatctaaggtcaagaagaatgaatgcacctttaaaatgacaagttttatcttgttactctcctgctaaaaacagtctgttgcattctatgagatggtatggatggtgtccagatgcctcactaggccacactcagggtccttgaatagctgcagtttgccaggcttttctgcattgtcgtggtggtccttcccttgttgctgctgcctgagagatactgcctggttcttacagacacagattatgtcatcnttgcagccttcacccaaagttgctccctccttctagggcattttgttttcctacttaataccaagtgtcagcatgttagtaataaacaggtgtctctaccattagtcaaaggtgggagttaagcctttcatctttgtagctttctccagtacctaaccatgatttacttcatgggaagtccctcaaagtactattaattatcntgtgttctcctgccttgcctcttaacaaaaattctgctgttcctgattatttccattttaccagtgttttgttccttttctatccaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttcta

SEQ ID NO: 373017 - DNA, 738 bp, Homo sapiens
tgatgagccggtccagcggtctacatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttcta

SEQ ID NO: 373018 - DNA, 2082 bp, Homo sapiens
agggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatgggtaagtaaagcaattcatatatcaaaataatttttgtctttgttatactatagataactggcttacatagtctttgagattttaagtcccacctacttaagaacttgaacctgagctaatacagtttcatcaaggttaaaccttggcttttggccatttgtggtggcttaggcttataatcacagcactttgggaggccaaggtgggaggatgatttaaggccaggagtttgagaccagcctgggcaacatagcgagaccccatctctacaaaaaatgcaaaaatcacctgggagtggtgatgtgcacctgtagtcgcagctacttgagaggctgaggtggaagaatcacttgagcccaggaggtcaaggctccagtgagctgtgattgcaccactgtactcgagccttgaggacagagtgagaccctgtctctgaataaattaattaattgaacaaacctccgttcccttaaatttttatcctaactccttcactcctacctctccttcaaaaaaaaaa

SEQ ID NO: 373019 - DNA, 1598 bp, Homo sapiens
  misc_feature (1364)..(1365): n is a, c, g, or t
  misc_feature (1374)..(1374): n is a, c, g, or t
  misc_feature (1382)..(1382): n is a, c, g, or t
  misc_feature (1408)..(1408): n is a, c, g, or t
  misc_feature (1421)..(1421): n is a, c, g, or t
  misc_feature (1433)..(1433): n is a, c, g, or t
  misc_feature (1598)..(1598): n is a, c, g, or t
agggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcagtcaccatggtggttnnacttctatnttgaaagnactatagaaatctctttctgaggatngataaggctattngcacgagacttngtatggaatacatgcagtagactgttaatacaatgccgcatttgatgaggatttcgatgatctctgtgatcatcaatgctgcgtctgaggaagatgatgatgagatgatctatgaatgaagtagcacatggaacatctaggctcgtgacttatagcgtcattgcn

SEQ ID NO: 373020 - DNA, 340 bp, Homo sapiens
cccaggatagaagagtcaataactgaagacttaaggtaatatttccaaagtcctaaatgttagtaactcataattcaggtggttacatgaggttttaaaaattgtctccatgttgctacttagatatatgcccgtattagagaaatgaagatattctttctatttttacacaggcatgtaaatgtagaacacttacctaagtttggggagttggaaagcaatatggaaaatactcatcttttaatactttagaatccagttttgagaaaaaagtcttaaaacctgattaaaaaaaatacgttttctttatttgtaatgcctcaggaggaggataactgga

SEQ ID NO: 373021 - DNA, 527 bp, Homo sapiens
agttaactacctcaacataatgggaaagattggccgtttaatcacttagcaatggaacaggcactgtgcctacttaggagcagaatgtccacattgcagacataatacctaggaagaaaaagggacctcctggaatactggcttggaaacctaaagaataaagtgatatgggagatcataagtaaggaattttaactcttttatctttaaaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggtatggttaaattttacacatatatatttacagtataagaaatacagttaggatggtattgttttaattaaacaagtataatatgtatttttaatatttggtaactaaatgaaatcttctccctattatatagattaaaaaatattctccac

SEQ ID NO: 373022 - DNA, 3965 bp, Homo sapiens
agggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttcta

SEQ ID NO: 373023 - DNA, 3943 bp, Homo sapiens
agggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttcta

SEQ ID NO: 373024 - DNA, 3714 bp, Homo sapiens
agggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggttgcaatattagttgctgtatatgtatcggatttcttcaaagaaagaacttcttttaaagaaagaaaagaggaggactctcatacaactcggcatgaacacctacaactggat

SEQ ID NO: 373025 - DNA, 2914 bp, Homo sapiens
cattctcattaataaaacagacttggtcccagaagaagatgtaaagaaattaagaacgacacttagatccataaatggactaggacaaatcttagaaacacaaagatcaagtttgcagaaaaaacttcagcatgtgccaggaacacaacctcaccttgatcataagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttcta

SEQ ID NO: 373026 - DNA, 1628 bp, Homo sapiens
gaatgtatctaagaagctccagtttccccagtctccccagcactgaagctttaacccagaagtatactgtaagatgttctttaaaaatattttttgtttgatttcatgaataaatctccttgtacattgttcactttattattgaactttctttatactttcatgtgctttagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttcta

SEQ ID NO: 373027 - DNA, 3008 bp, Homo sapiens
agggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagacaggtatggcagaaatttggtttttatagtagaattctatatgtttcactgaataaatatgtgtttgtcattttcttatcctgttggtttaattggctaaaacaggaaaatgtgagctatcttttaaataaactgtcagctctgaacctgtcagctctcatcagcaagacaagataaagttcattttgctatagtttgatatttcacataggatgttctgttttttcttcttttttaaatttgagatataatttacacagcatagcattcacccttttaaaatgtccaactcactggtttttagtgtattcacagatacttgcaaccatcaccactatgtaacttcagaacattcttctcaccctctgaaggaactttatacccattagcagccactctctgtttctcccatcctccagcccttggcaatcacaaatctttctatctgtatggttttgcctattctggatatttcttataaatagaatcatgtaata

SEQ ID NO: 373028 - DNA, 521 bp, Homo sapiens
ttgagatttctccctcaaggcctgttgccttgttattatgattaggaagaaactttctcttctcatttaaaattttccactttaggattagatagcttagggttgtgttttaacgaactcatgttgtatgatccttactgaagcccttttgtgtggagatcattctttcatttgaagtgtatgtatgtctgtttgagtatgtacactatacacatacacatacatgcacacatatgtaattttacattgtatatatacatatatatgtatatatacacatgcatgctatttttttaaacaaaaatgtggcaggatatcttctagggaccagagaaggaaggagaatctagagcagaggtatatgcttgctactcaagacagtgaagaggttgatgaaaagacatcactgatataaagttttcttaatgacaaaggatacagaaaattctgtaaatagttacagaaagcagaatataattgtatttggaaataatcattatgaataaaatgagaaaatcaaa

SEQ ID NO: 373029 - DNA, 746 bp, Homo sapiens
agcttggaaatctgtacacagtttactgtgaaccaagtgaagcaggtaccaacgcccatattcagtatatccagtgcggtaccatatgtggctttacacacacacacacacgctaccacagaaaaaggggtggaatgatccagccagaaccgtgccggtgagaagtacgtcgtggagttctcgctcacccctgctctgtggtttcagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatgggttccaacaaattgcaaataaaactgtatggaaacgat

SEQ ID NO: 373030 - DNA, 4496 bp, Homo sapiens
gaacatggcggcccccgagtcagggccggctttgagtccaggcactgcagaggcctagaggcaaccaaaaacatggtgcatcctttatcatcacgaaagcaattcgagatcgtttattatttttacgccaatacatctggtacagcccggcaccttttttgctccctgatggactggttcgcttggttaataaacagataaactggcatttggtacttgcaagcaatagcactagagtgcatctatacctgtgaacgaaatgatcaactctgtctttgctatgacctactagaatgtctgccagaaagaggatatggtgataagacagaggcaaccacaaagcttcatgacatggtagaccaactggaacaaattctcagtgtgtcagagcttttggaaaaacatggactcgagaaaccaatttcatttgttaaaaacactcaatctagctcagaagaggcacgcaagctgatggttagattgacgaggcacactggccggaagcagcctcctgtcagtgagtctcattggagaacgttgctgcaagacatgttaactatgcagcagaatgtatacacatgtctagattctgatgcctgctatgagatatttacagaaagccttctgtgctctagtcgccttgaaaacatccacctggctggacagatgatgcactgcagtgcttgttcagaaaatcctccagctggtatagcccataaagggaaaccccactacagggtcagctacgaaaagagtattgacttggttttggctgccagcagagagtacttcaattcttctaccaacctcactgatagctgcatggatctagccaggtgctgcttacaactgataacagacagaccccctgccattcaagaggagctagatcttatccaagccgttggatgtcttgaagaatttggggtaaagatcctgcctttgcaagtgcgattgtgccctgatcggatcagtctcatcaaggagtgtatttcccagtcccccacatgctataaacaatccaccaagcttctgggccttgctgagctgctgagggttgcaggtgagaacccagaagaaaggcggggacaggttctaatccttttagtggagcaggcacttcgcttccatgactacaaagcagccagtatgcattgtcaggagctgatggccacaggttatcctaaaagttgggatgtttgtagccagttaggacaatcagaaggttaccaggacttggccactcgtcaagagctcatggcttttgctttgacacattgccctcctagcagcattgaacttcttttggcagctagcagctctctgcagacagaaattctttatcaaagagtgaatttccagatccatcatgaaggaggggaaaatatcagtgcttcaccattaactagtaaagcagtacaagaggatgaagtaggtgttccaggtagcaattcagctgacctattgcgctggaccactgctaccaccatgaaagtcctttccaacaccacaaccaccaccaaagcggtgctgcaggccgtcagtgatgggcagtggtggaagaagtctttaacttaccttcgaccccttcaggggcaaaaatgtggtggtgcatatcaaatcggaactacagccaatgaagatctagagaaacaagggtgtcatcctttttatgaatctgtcatctcaaatccttttgtcgctgagtctgaagggacctatgacacctatcagcatgttccagtggaaagctttgcagaagtattgctgagaactggaaaattggcagaggctaaaaataaaggagaagtatttccaacaactgaagttctcttgcaactagcaagtgaagccttgccaaatgacatgaccttggctcttgcttaccttcttgccttaccacaagtgttagatgctaaccggtgctttgaaaagcagtccccctctgcattatctctccagctggcagcgtattactatagcctccagatctatgcccgattggccccatgtttcagggacaagtgccatcctctttacagggctgatcccaaagaactaatcaagatggtcaccaggcatgtgactcgacatgagcacgaagcctggcctgaagaccttatttcactgaccaagcagttacactgctacaatgaacgtctcctggatttcactcaggcgcagatccttcagggccttcggaagggtgtggacgtgcagcggtttactgcagatgaccagtataaaagggaaactatccttggtctggcagaaactctagaggaaagcgtctacagcattgctatttctctggcacaacgttacagtgtctcccgctgggaagtttttatgacccatttggagttcctcttcacggacagtggtttgtccacactagaaattgaaaatagagcccaagaccttcatctctttgagactttgaagactgatccagaagcctttcaccagcacatggtcaagtatatttaccctactattggtggctttgatcacgaaaggctgcagtattatttcactcttctggaaaactgtggctgtgcagatttggggaactgtgccattaaaccagaaacccacattcgactgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctgtctgtggaagcccgtaaagagatgactagaaaggctattaagacagtcaaacattttattgagaagccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaagggtgaggagctggtttcacctgaggacctgctggagtggctgcggcctttctgtgctgatgacgcctggccggtgcggccccgcattcacgtgctgcagattttggggcaatcatttcacctgactgaggaggacagcaagctcctcgtgttctttagaactgaagccattctcaaagcctcctggccccagagacaggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatgggttccaacaaattgcaaataaaactgtatggaaacgat

SEQ ID NO: 373031 - DNA, 637 bp, Homo sapiens
tagtgatgattgcagtggggttcttgtgtcttcttatgttaagaggagccccgtctgtcatcccaatctgtgacctacctcagaggtgctcgtgacccacacacgcttttaaacccaggccagggcatgaatgatgatgaaggcagcccagtggagagcgagggatccaagggggaggcgaacaaagcaaacaccccctcacgctgtgcctgtcttatttcttgaaggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatgggttccaacaaattgcaaataaaactgtatggaaacgat

SEQ ID NO: 373032 - DNA, 464 bp, Homo sapiens
tacaataacaaccggcccgcatcacaccaacccctacaacgtcaacgactccaggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatgggttccaacaaattgcaaataaaactgtatggaaacgat

SEQ ID NO: 373033 - DNA, 732 bp, Homo sapiens
catctgaacagagatatgatgctgaattctttaagaaattcagaaatcagaatattgttctctcagcaagaacttatgctcaggaaagtaatgtacaagccctggaaattctgtttacttaccatggttccgacctgcttcctcatcgccttgcaattctgtccaactttccagagaccacttctccacatgaatattctgttttgctgcccgaagcttgttttaacggtgactccctgatgatcattccttggcatgaacataaacaccgagctaaagattggtgcgaggagttggcttgcagaatggttgttgagccgaatctccaagatgaaagtgaattcttgtatgctgcacagcctgagttactaaggttcaggatgacccagcttacggtggagaaggttatggactggtatcagaccagagcagaggaaatagagcattatgctcggcaggtggactgtgcattgtcacttattcgacttgggatggagcggaatattcctggtttgctggttctctgtgacaatttggttactctggaaacattggtttatgaagccaggtgtgatgtaactctaaccctgaaagaactccagcagatgaaagacattgaaaaactaagattactgatgaatagtgtaggttttattttaacttcctttttaaatattttaaagcattttctatgcactttgatacatatgtgtctcaaaccaaagatgaaat

SEQ ID NO: 373034 - DNA, 5131 bp, Homo sapiens
catctgaacagagatatgatgctgaattctttaagaaattcagaaatcagaatattgttctctcagcaagaacttatgctcaggaaagtaatgtacaagccctggaaattctgtttacttaccatggttccgacctgcttcctcatcgccttgcaattctgtccaactttccagagaccacttctccacatgaatattctgttttgctgcccgaagcttgttttaacggtgactccctgatgatcattccttggcatgaacataaacaccgagctaaagattggtgcgaggagttggcttgcagaatggttgttgagccgaatctccaagatgaaagtgaattcttgtatgctgcacagcctgagttactaaggttcaggatgacccagcttacggtggagaaggttatggactggtatcagaccagagcagaggaaatagagcattatgctcggcaggtggactgtgcattgtcacttattcgacttgggatggagcggaatattcctggtttgctggttctctgtgacaatttggttactctggaaacattggtttatgaagccaggtgtgatgtaactctaaccctgaaagaactccagcagatgaaagacattgaaaaactaagattactgatgaatagttgttctgaggataaatatgtgacaagtgcctaccagtggatggttccctttcttcatcgttgtgagaaacagtcgcctggtgtggctaatgagctattaaaagaatatttagtaactttagctaaaggggacttaaaatttcccctgaagatatttcagcattccaaaccagatctgcagcaaaaaattattcctgatcaggaccaactgatggcaatagcactagagtgcatctatacctgtgaacgaaatgatcaactctgtctttgctatgacctactagaatgtctgccagaaagaggatatggtgataagacagaggcaaccacaaagcttcatgacatggtagaccaactggaacaaattctcagtgtgtcagagcttttggaaaaacatggactcgagaaaccaatttcatttgttaaaaacactcaatctagctcagaagaggcacgcaagctgatggttagattgacgaggcacactggccggaagcagcctcctgtcagtgagtctcattggagaacgttgctgcaagacatgttaactatgcagcagaatgtatacacatgtctagattctgatgcctgctatgagatatttacagaaagccttctgtgctctagtcgccttgaaaacatccacctggctggacagatgatgcactgcagtgcttgttcagaaaatcctccagctggtatagcccataaagggaaaccccactacagggtcagctacgaaaagagtattgacttggttttggctgccagcagagagtacttcaattcttctaccaacctcactgatagctgcatggatctagccaggtgctgcttacaactgataacagacagaccccctgccattcaagaggagctagatcttatccaagccgttggatgtcttgaagaatttggggtaaagatcctgcctttgcaagtgcgattgtgccctgatcggatcagtctcatcaaggagtgtatttcccagtcccccacatgctataaacaatccaccaagcttctgggccttgctgagctgctgagggttgcaggtgagaacccagaagaaaggcggggacaggttctaatccttttagtggagcaggcacttcgcttccatgactacaaagcagccagtatgcattgtcaggagctgatggccacaggttatcctaaaagttgggatgtttgtagccagttaggacaatcagaaggttaccaggacttggccactcgtcaagagctcatggcttttgctttgacacattgccctcctagcagcattgaacttcttttggcagctagcagctctctgcagacagaaattctttatcaaagagtgaatttccagatccatcatgaaggaggggaaaatatcagtgcttcaccattaactagtaaagcagtacaagaggatgaagtaggtgttccaggtagcaattcagctgacctattgcgctggaccactgctaccaccatgaaagtcctttccaacaccacaaccaccaccaaagcggtgctgcaggccgtcagtgatgggcagtggtggaagaagtctttaacttaccttcgaccccttcaggggcaaaaatgtggtggtgcatatcaaatcggaactacagccaatgaagatctagagaaacaagggtgtcatcctttttatgaatctgtcatctcaaatccttttgtcgctgagtctgaagggacctatgacacctatcagcatgttccagtggaaagctttgcagaagtattgctgagaactggaaaattggcagaggctaaaaataaaggagaagtatttccaacaactgaagttctcttgcaactagcaagtgaagccttgccaaatgacatgaccttggctcttgcttaccttcttgccttaccacaagtgttagatgctaaccggtgctttgaaaagcagtccccctctgcattatctctccagctggcagcgtattactatagcctccagatctatgcccgattggccccatgtttcagggacaagtgccatcctctttacagggctgatcccaaagaactaatcaagatggtcaccaggcatgtgactcgacatgagcacgaagcctggcctgaagaccttatttcactgaccaagcagttacactgctacaatgaacgtctcctggatttcactcaggcgcagatccttcagggccttcggaagggtgtggacgtgcagcggtttactgcagatgaccagtataaaagggaaactatccttggtctggcagaaactctagaggaaagcgtctacagcattgctatttctctggcacaacgttacagtgtctcccgctgggaagtttttatgacccatttggagttcctcttcacggacagtggtttgtccacactagaaattgaaaatagagcccaagaccttcatctctttgagactttgaagactgatccagaagcctttcaccagcacatggtcaagtatatttaccctactattggtggctttgatcacgaaaggctgcagtattatttcactcttctggaaaactgtggctgtgcagatttggggaactgtgccattaaaccagaaacccacattcgactgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctgtctgtggaagcccgtaaagagatgactagaaaggctattaagacagtcaaacattttattgagaagccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaagggtgaggagctggtttcacctgaggacctgctggagtggctgcggcctttctgtgctgatgacgcctggccggtgcggccccgcattcacgtgctgcagattttggggcaatcatttcacctgactgaggaggacagcaagctcctcgtgttctttagaactgaagccattctcaaagcctcctggccccagagacaggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatgggttccaacaaattgcaaataaaactgtatggaaacgat

SEQ ID NO: 373035 - DNA, 2090 bp, Homo sapiens
tcaaacttataacgccaatccaaagatttctacagtcgcctgaatcatgaaccagtaccttatgtgtttcaaaatacaccaaaactaccccctcgtttttccaaacagtttaatttcgcaatttgttggaaccatggaacacaatcggcagatacacatgttgcttctgggaacagcattcaactccagatgctttttctgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctgtctgtggaagcccgtaaagagatgactagaaaggctattaagacagtcaaacattttattgagaagccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaagggtgaggagctggtttcacctgaggacctgctggagtggctgcggcctttctgtgctgatgacgcctggccggtgcggccccgcattcacgtgctgcagattttggggcaatcatttcacctgactgaggaggacagcaagctcctcgtgttctttagaactgaagccattctcaaagcctcctggccccagagacaggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatgggttccaacaaattgcaaataaaactgtatggaaacgat

SEQ ID NO: 373036 - DNA, 5308 bp, Homo sapiens
catctgaacagagatatgatgctgaattctttaagaaattcagaaatcagaatattgttctctcagcaagaacttatgctcaggaaagtaatgtacaagccctggaaattctgtttacttaccatggttccgacctgcttcctcatcgccttgcaattctgtccaactttccagagaccacttctccacatgaatattctgttttgctgcccgaagcttgttttaacggtgactccctgatgatcattccttggcatgaacataaacaccgagctaaagattggtgcgaggagttggcttgcagaatggttgttgagccgaatctccaagatgaaagtgaattcttgtatgctgcacagcctgagttactaaggttcaggatgacccagcttacggtggagaaggttatggactggtatcagaccagagcagaggaaatagagcattatgctcggcaggtggactgtgcattgtcacttattcgacttgggatggagcggaatattcctggtttgctggttctctgtgacaatttggttactctggaaacattggtttatgaagccaggtgtgatgtaactctaaccctgaaagaactccagcagatgaaagacattgaaaaactaagattactgatgaatagttgttctgaggataaatatgtgacaagtgcctaccagtggatggttccctttcttcatcgttgtgagaaacagtcgcctggtgtggctaatgagctattaaaagaatatttagtaactttagctaaaggggacttaaaatttcccctgaagatatttcagcattccaaaccagatctgcagcaaaaaattattcctgatcaggaccaactgatggcaatagcactagagtgcatctatacctgtgaacgaaatgatcaactctgtctttgctatgacctactagaatgtctgccagaaagaggatatggtgataagacagaggcaaccacaaagcttcatgacatggtagaccaactggaacaaattctcagtgtgtcagagcttttggaaaaacatggactcgagaaaccaatttcatttgttaaaaacactcaatctagctcagaagaggcacgcaagctgatggttagattgacgaggcacactggccggaagcagcctcctgtcagtgagtctcattggagaacgttgctgcaagacatgttaactatgcagcagaatgtatacacatgtctagattctgatgcctgctatgagatatttacagaaagccttctgtgctctagtcgccttgaaaacatccacctggctggacagatgatgcactgcagtgcttgttcagaaaatcctccagctggtatagcccataaagggaaaccccactacagggtcagctacgaaaagagtattgacttggttttggctgccagcagagagtacttcaattcttctaccaacctcactgatagctgcatggatctagccaggtgctgcttacaactgataacagacagaccccctgccattcaagaggagctagatcttatccaagccgttggatgtcttgaagaatttggggtaaagatcctgcctttgcaagtgcgattgtgccctgatcggatcagtctcatcaaggagtgtatttcccagtcccccacatgctataaacaatccaccaagcttctgggccttgctgagctgctgagggttgcaggtgagaacccagaagaaaggcggggacaggttctaatccttttagtggagcaggcacttcgcttccatgactacaaagcagccagtatgcattgtcaggagctgatggccacaggttatcctaaaagttgggatgtttgtagccagttaggacaatcagaaggttaccaggacttggccactcgtcaagagctcatggcttttgctttgacacattgccctcctagcagcattgaacttcttttggcagctagcagctctctgcagacagaaattctttatcaaagagtgaatttccagatccatcatgaaggaggggaaaatatcagtgcttcaccattaactagtaaagcagtacaagaggatgaagtaggtgttccaggtagcaattcagctgacctattgcgctggaccactgctaccaccatgaaagtcctttccaacaccacaaccaccaccaaagcggtgctgcaggccgtcagtgatgggcagtggtggaagaagtctttaacttaccttcgaccccttcaggggcaaaaatgtggtggtgcatatcaaatcggaactacagccaatgaagatctagagaaacaagggtgtcatcctttttatgaatctgtcatctcaaatccttttgtcgctgagtctgaagggacctatgacacctatcagcatgttccagtggaaagctttgcagaagtattgctgagaactggaaaattggcagaggctaaaaataaaggagaagtatttccaacaactgaagttctcttgcaactagcaagtgaagccttgccaaatgacatgaccttggctcttgcttaccttcttgccttaccacaagtgttagatgctaaccggtgctttgaaaagcagtccccctctgcattatctctccagctggcagcgtattactatagcctccagatctatgcccgattggccccatgtttcagggacaagtgccatcctctttacagggctgatcccaaagaactaatcaagatggtcaccaggcatgtgactcgacatgagcacgaagcctggcctgaagaccttatttcactgaccaagcagttacactgctacaatgaacgtctcctggatttcactcaggcgcagatccttcagggccttcggaagggtgtggacgtgcagcggtttactgcagatgaccagtataaaagggaaactatccttggtctggcagaaactctagaggaaagcgtctacagcattgctatttctctggcacaacgttacagtgtctcccgctgggaagtttttatgacccatttggagttcctcttcacggacagtggtttgtccacactagaaattgaaaatagagcccaagaccttcatctctttgagactttgaagactgatccagaagcctttcaccagcacatggtcaagtatatttaccctactattggtggctttgatcacgaaaggctgcagtattatttcactcttctggaaaactgtggctgtgcagatttggggaactgtgccattaaaccagaaacccacattcgactgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctgtctgtggaagcccgtaaagagatgactagaaaggctattaagacagtcaaacattttattgagaagccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaagggtgaggagctggtttcacctgaggacctgctggagtggctgcggcctttctgtgctgatgacgcctggccggtgcggccccgcattcacgtgctgcagattttggggcaatcatttcacctgactgaggaggacagcaagctcctcgtgttctttagaactgaagccattctcaaagcctcctggccccagagacaggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatgggttccaacaaattgcaaataaaactgtatggaaacgataaaaaaaatcgccttcctggcttcacggggagctctgcggcccttccttaagggaggtaattatgatcctcgttactgaccgtggctcggccgtgggctgtggcgacggttaactcattaaggcggatcggtgttcccatacatgtgatacccggatgaactgtaataggccgtcag

SEQ ID NO: 373037 - DNA, 869 bp, Homo sapiens
  misc_feature (39)..(39): n is a, c, g, or t
atgaaaggcagagggtccagtttgtcagcatttaagagnacatctaggtatgtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatgggttccaacaaattgcaaataaaactgtatggaaacgat

SEQ ID NO: 373038 - DNA, 4821 bp, Homo sapiens
catctgaacagagatatgatgctgaattctttaagaaattcagaaatcagaatattgttctctcagcaagaacttatgctcaggaaagtaatgtacaagccctggaaattctgtttacttaccatggttccgacctgcttcctcatcgccttgcaattctgtccaactttccagagaccacttctccacatgaatattctgttttgctgcccgaagcttgttttaacggtgactccctgatgatcattccttggcatgaacataaacaccgagctaaagattggtgcgaggagttggcttgcagaatggttgttgagccgaatctccaagatgaaagtgaattcttgtatgctgcacagcctgagttactaaggttcaggatgacccagcttacggtggagaaggttatggactggtatcagaccagagcagaggaaatagagcattatgctcggcaggtggactgtgcattgtcacttattcgacttgggatggagcggaatattcctggtttgctggttctctgtgacaatttggttactctggaaacattggtttatgaagccaggtgtgatgtaactctaaccctgaaagaactccagcagatgaaagacattgaaaaactaagattactgatgaatagttgttctgaggataaatatgtgacaagtgcctaccagtggatggttccctttcttcatcgttgtgagaaacagtcgcctggtgtggctaatgagctattaaaagaatatttagtaactttagctaaaggggacttaaaatttcccctgaagatatttcagcattccaaaccagatctgcagcaaaaaattattcctgatcaggaccaactgatggcaatagcactagagtgcatctatacctgtgaacgaaatgatcaactctgtctttgctatgacctactagaatgtctgccagaaagaggatatggtgataagacagaggcaaccacaaagcttcatgacatggtagaccaactggaacaaattctcagtgtgtcagagcttttggaaaaacatggactcgagaaaccaatttcatttgttaaaaacactcaatctagctcagaagaggcacgcaagctgatggttagattgacgaggcacactggccggaagcagcctcctgtcagtgagtctcattggagaacgttgctgcaagacatgttaactatgcagcagaatgtatacacatgtctagattctgatgcctgctatgagatatttacagaaagccttctgtgctctagtcgccttgaaaacatccacctggctggacagatgatgcactgcagtgcttgttcagaaaatcctccagctggtatagcccataaagggaaaccccactacagggtcagctacgaaaagagtattgacttggttttggctgccagcagagagtacttcaattcttctaccaacctcactgatagctgcatggatctagccaggtgctgcttacaactgataacagacagaccccctgccattcaagaggagctagatcttatccaagccgttggatgtcttgaagaatttggggtaaagatcctgcctttgcaagtgcgattgtgccctgatcggatcagtctcatcaaggagtgtatttcccagtcccccacatgctataaacaatccaccaagcttctgggccttgctgagctgctgagggttgcaggtgagaacccagaagaaaggcggggacaggttctaatccttttagtggagcaggcacttcgcttccatgactacaaagcagccagtatgcattgtcaggagctgatggccacaggttatcctaaaagttgggatgtttgtagccagttaggacaatcagaaggttaccaggacttggccactcgtcaagagctcatggcttttgctttgacacattgccctcctagcagcattgaacttcttttggcagctagcagctctctgcagacagaaattctttatcaaagagtgaatttccagatccatcatgaaggaggggaaaatatcagtgcttcaccattaactagtaaagcagtacaagaggatgaagtaggtgttccaggtagcaattcagctgacctattgcgctggaccactgctaccaccatgaaagtcctttccaacaccacaaccaccaccaaagcggtgctgcaggccgtcagtgatgggcagtggtggaagaagtctttaacttaccttcgaccccttcaggggcaaaaatgtggtggtgcatatcaaatcggaactacagccaatgaagatctagagaaacaagggtgtcatcctttttatgaatctgtcatctcaaatccttttgtcgctgagtctgaagggacctatgacacctatcagcatgttccagtggaaagctttgcagaagtattgctgagaactggaaaattggcagaggctaaaaataaaggagaagtatttccaacaactgaagttctcttgcaactagcaagtgaagccttgccaaatgacatgaccttggctcttgcttaccttcttgccttaccacaagtgttagatgctaaccggtgctttgaaaagcagtccccctctgcattatctctccagctggcagcgtattactatagcctccagatctatgcccgattggccccatgtttcagggacaagtgccatcctctttacagggctgatcccaaagaactaatcaagatggtcaccaggcatgtgactcgacatgagcacgaagcctggcctgaagaccttatttcactgaccaagcagttacactgctacaatgaacgtctcctggatttcactcaggcgcagatccttcagggccttcggaagggtgtggacgtgcagcggtttactgcagatgaccagtataaaagggaaactatccttggtctggcagaaactctagaggaaagcgtctacagcattgctatttctctggcacaacgttacagtgtctcccgctgggaagtttttatgacccatttggagttcctcttcacggacagtggtttgtccacactagaaattgaaaatagagcccaagaccttcatctctttgagactttgaagactgatccagaagcctttcaccagcacatggtcaagtatatttaccctactattggtggctttgatcacgaaaggctgcagtattatttcactcttctggaaaactgtggctgtgcagatttggggaactgtgccattaaaccagaaacccacattcgactgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctgtctgtggaagcccgtaaagagatgactagaaaggctattaagacagtcaaacattttattgagaagccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaagggtgaggagctggtttcacctgaggacctgctggagtggctgcggcctttctgtgctgatgacgcctggccggtgcggccccgcattcacgtgctgcagattttggggcaatcatttcacctgactgaggaggacagcaagctcctcgtgttctttagaactgaagccattctcaaagcctcctggccccagagacaggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggattgccgaaagcttggccttggggttgggcaaaagggttgggttgggtcttccc

SEQ ID NO: 373039 - DNA, 4930 bp, Homo sapiens
catctgaacagagatatgatgctgaattctttaagaaattcagaaatcagaatattgttctctcagcaagaacttatgctcaggaaagtaatgtacaagccctggaaattctgtttacttaccatggttccgacctgcttcctcatcgccttgcaattctgtccaactttccagagaccacttctccacatgaatattctgttttgctgcccgaagcttgttttaacggtgactccctgatgatcattccttggcatgaacataaacaccgagctaaagattggtgcgaggagttggcttgcagaatggttgttgagccgaatctccaagatgaaagtgaattcttgtatgctgcacagcctgagttactaaggttcaggatgacccagcttacggtggagaaggttatggactggtatcagaccagagcagaggaaatagagcattatgctcggcaggtggactgtgcattgtcacttattcgacttgggatggagcggaatattcctggtttgctggttctctgtgacaatttggttactctggaaacattggtttatgaagccaggtgtgatgtaactctaaccctgaaagaactccagcagatgaaagacattgaaaaactaagattactgatgaatagttgttctgaggataaatatgtgacaagtgcctaccagtggatggttccctttcttcatcgttgtgagaaacagtcgcctggtgtggctaatgagctattaaaagaatatttagtaactttagctaaaggggacttaaaatttcccctgaagatatttcagcattccaaaccagatctgcagcaaaaaattattcctgatcaggaccaactgatggcaatagcactagagtgcatctatacctgtgaacgaaatgatcaactctgtctttgctatgacctactagaatgtctgccagaaagaggatatggtgataagacagaggcaaccacaaagcttcatgacatggtagaccaactggaacaaattctcagtgtgtcagagcttttggaaaaacatggactcgagaaaccaatttcatttgttaaaaacactcaatctagctcagaagaggcacgcaagctgatggttagattgacgaggcacactggccggaagcagcctcctgtcagtgagtctcattggagaacgttgctgcaagacatgttaactatgcagcagaatgtatacacatgtctagattctgatgcctgctatgagatatttacagaaagccttctgtgctctagtcgccttgaaaacatccacctggctggacagatgatgcactgcagtgcttgttcagaaaatcctccagctggtatagcccataaagggaaaccccactacagggtcagctacgaaaagagtattgacttggttttggctgccagcagagagtacttcaattcttctaccaacctcactgatagctgcatggatctagccaggtgctgcttacaactgataacagacagaccccctgccattcaagaggagctagatcttatccaagccgttggatgtcttgaagaatttggggtaaagatcctgcctttgcaagtgcgattgtgccctgatcggatcagtctcatcaaggagtgtatttcccagtcccccacatgctataaacaatccaccaagcttctgggccttgctgagctgctgagggttgcaggtgagaacccagaagaaaggcggggacaggttctaatccttttagtggagcaggcacttcgcttccatgactacaaagcagccagtatgcattgtcaggagctgatggccacaggttatcctaaaagttgggatgtttgtagccagttaggacaatcagaaggttaccaggacttggccactcgtcaagagctcatggcttttgctttgacacattgccctcctagcagcattgaacttcttttggcagctagcagctctctgcagacagaaattctttatcaaagagtgaatttccagatccatcatgaaggaggggaaaatatcagtgcttcaccattaactagtaaagcagtacaagaggatgaagtaggtgttccaggtagcaattcagctgacctattgcgctggaccactgctaccaccatgaaagtcctttccaacaccacaaccaccaccaaagcggtgctgcaggccgtcagtgatgggcagtggtggaagaagtctttaacttaccttcgaccccttcaggggcaaaaatgtggtggtgcatatcaaatcggaactacagccaatgaagatctagagaaacaagggtgtcatcctttttatgaatctgtcatctcaaatccttttgtcgctgagtctgaagggacctatgacacctatcagcatgttccagtggaaagctttgcagaagtattgctgagaactggaaaattggcagaggctaaaaataaaggagaagtatttccaacaactgaagttctcttgcaactagcaagtgaagccttgccaaatgacatgaccttggctcttgcttaccttcttgccttaccacaagtgttagatgctaaccggtgctttgaaaagcagtccccctctgcattatctctccagctggcagcgtattactatagcctccagatctatgcccgattggccccatgtttcagggacaagtgccatcctctttacagggctgatcccaaagaactaatcaagatggtcaccaggcatgtgactcgacatgagcacgaagcctggcctgaagaccttatttcactgaccaagcagttacactgctacaatgaacgtctcctggatttcactcaggcgcagatccttcagggccttcggaagggtgtggacgtgcagcggtttactgcagatgaccagtataaaagggaaactatccttggtctggcagaaactctagaggaaagcgtctacagcattgctatttctctggcacaacgttacagtgtctcccgctgggaagtttttatgacccatttggagttcctcttcacggacagtggtttgtccacactagaaattgaaaatagagcccaagaccttcatctctttgagactttgaagactgatccagaagcctttcaccagcacatggtcaagtatatttaccctactattggtggctttgatcacgaaaggctgcagtattatttcactcttctggaaaactgtggctgtgcagatttggggaactgtgccattaaaccagaaacccacattcgactgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctgtctgtggaagcccgtaaagagatgactagaaaggctattaagacagtcaaacattttattgagaagccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaagggtgaggagctggtttcacctgaggacctgctggagtggctgcggcctttctgtgctgatgacgcctggccggtgcggccccgcattcacgtgctgcagattttggggcaatcatttcacctgactgaggaggacagcaagctcctcgtgttctttagaactgaagccattctcaaagcctcctggccccagagacaggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggatatcttctagggaccagagaaggaaggagaatctagagcagaggtatatgcttgctactcaagacagtgaagaggttgatgaaaagacatcactgatataaagttttcttaatgacaaaggatacagaaaattctgtaaatagttacagaaagcagaatataattgtatttggaaataatcattatgaataaaatgagaaaatcaaa

SEQ ID NO: 373040 - DNA, 1613 bp, Homo sapiens
catctgaacagagatatgatgctgaattctttaagaaattcagaaatcagaatattgttctctcagcaagaacttatgctcaggaaagtaatgtacaagccctggaaattctgtttacttaccatggttccgacctgcttcctcatcgccttgcaattctgtccaactttccagagaccacttctccacatgaatattctgttttgctgcccgaagcttgttttaacggtgactccctgatgatcattccttggcatgaacataaacaccgagctaaagattggtgcgaggagttggcttgcagaatggttgttgagccgaatctccaagatgaaagtgaattcttgtatgctgcacagcctgagttactaaggttcaggatgacccagcttacggtggagaaggttatggactggtatcagaccagagcagaggaaatagagcattatgctcggcaggtggactgtgcattgtcacttattcgacttgggatggagcggaatattcctggtttgctggttctctgtgacaatttggttactctggaaacattggtttatgaagccaggtgtgatgtaactctaaccctgaaagaactccagcagatgaaagacattgaaaaactaagattactgatgaatagttgttctgaggataaatatgtgacaagtgcctaccagtggatggttccctttcttcatcgttgtgagaaacagtcgcctggtgtggctaatgagctattaaaagaatatttagtaactttagctaaaggggacttaaaatttcccctgaagatatttcagcattccaaaccagatctgcagcaaaaaattattcctgatcaggaccaactgatggcaatagcactagagtgcatctatacctgtgaacgaaatgatcaactctgtctttgctatgacctactagaatgtctgccagaaagaggatatggtgataagacagaggcaaccacaaagcttcatgacatggtagaccaactggaacaaattctcagtgtgtcagagcttttggaaaaacatggactcgagaaaccaatttcatttgttaaaaacactcaatctagctcagaagaggcacgcaagctgatggttagattgacgaggcacactggccggaagcagcctcctgtcagtgagtctcattggagaacgttgctgcaagacatgttaactatgcagcagaatgtatacacatgtctagattctgatgcctgctatgagatatttacagaaagccttctgtgctctagtcgccttgaaaacatccacctggctggacagatgatgcactgcagtgcttgttcagaaaatcctccagctggtatagcccataaagggaaaccccactacagggtcagctacgaaaagagtattgacttggttttggctgccagcagagagtacttcaattcttctaccaacctcactgatagctgcatggatctagccaggtgctgcttacaactgataacagacagaccccctgccattcaagaggagctagatcttatccaagccgttggatgtcttgaagaatttggggtaaagatcctgcctttgcaaggtgagttttctacttactgttgcattgtt

SEQ ID NO: 373041 - DNA, 2838 bp, Homo sapiens
ccaacggagactgcggtatccgcggctggagacccagcggcgagtagccttttgctcccggacggacttgagaggcttaaaggatggcctcgtcagatctggaacaattatgctctcatgttaatgaaaagatggcaatattaagaaaaccttatcattaagaaactgtgttctcttgcaactagcaagtgaagccttgccaaatgacatgaccttggctcttgcttaccttcttgccttaccacaagtgttagatgctaaccggtgctttgaaaagcagtccccctctgcattatctctccagctggcagcgtattactatagcctccagatctatgcccgattggccccatgtttcagggacaagtgccatcctctttacagggctgatcccaaagaactaatcaagatggtcaccaggcatgtgactcgacatgagcacgaagcctggcctgaagaccttatttcactgaccaagcagttacactgctacaatgaacgtctcctggatttcactcaggcgcagatccttcagggccttcggaagggtgtggacgtgcagcggtttactgcagatgaccagtataaaagggaaactatccttggtctggcagaaactctagaggaaagcgtctacagcattgctatttctctggcacaacgttacagtgtctcccgctgggaagtttttatgacccatttggagttcctcttcacggacagtggtttgtccacactagaaattgaaaatagagcccaagaccttcatctctttgagactttgaagactgatccagaagcctttcaccagcacatggtcaagtatatttaccctactattggtggctttgatcacgaaaggctgcagtattatttcactcttctggaaaactgtggctgtgcagatttggggaactgtgccattaaaccagaaacccacattcgactgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctgtctgtggaagcccgtaaagagatgactagaaaggctattaagacagtcaaacattttattgagaagccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaagggtgaggagctggtttcacctgaggacctgctggagtggctgcggcctttctgtgctgatgacgcctggccggtgcggccccgcattcacgtgctgcagattttggggcaatcatttcacctgactgaggaggacagcaagctcctcgtgttctttagaactgaagccattctcaaagcctcctggccccagagacaggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatgggttccaacaaattgcaaataaaactgtatggaaacgat

SEQ ID NO: 373042 - DNA, 2196 bp, Homo sapiens
agttgaagagttagtgtgagagtggttaatagagagagagggagcatctaacccctattagttattaatcccccaggatttaagtttgtccacactagaaattgaaaatagagcccaagaccttcatctctttgagactttgaagactgatccagaagcctttcaccagcacatggtcaagtatatttaccctactattggtggctttgatcacgaaaggctgcagtattatttcactcttctggaaaactgtggctgtgcagatttggggaactgtgccattaaaccagaaacccacattcgactgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctgtctgtggaagcccgtaaagagatgactagaaaggctattaagacagtcaaacattttattgagaagccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaagggtgaggagctggtttcacctgaggacctgctggagtggctgcggcctttctgtgctgatgacgcctggccggtgcggccccgcattcacgtgctgcagattttggggcaatcatttcacctgactgaggaggacagcaagctcctcgtgttctttagaactgaagccattctcaaagcctcctggccccagagacaggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatgggttccaacaaattgcaaataaaactgtatggaaacgat

SEQ ID NO: 373043 - DNA, 913 bp, Homo sapiens
  misc_feature (27)..(27): n is a, c, g, or t
caaacaacacacgaacaaaaccgaganaacaacaacaccccatatcacaccaatacacgcctccaagatttagaacgaaccacctcgaatctgtggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatgggttccaacaaattgcaaataaaactgtatggaaacgat

SEQ ID NO: 373044 - DNA, 900 bp, Homo sapiens
acacccacttgtccagccagggaccacgaccctgatttttataacacaaacccccccctagcttattgtaccatgtaaggacgtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatgggttccaacaaattgcaaataaaactgtatggaaacgat

SEQ ID NO: 373045 - DNA, 916 bp, Homo sapiens
ccggcatccggtcagagccgcccggctgtaatcggacgaccccccgcccccgcgcgcccgcgttcgcgcaccaaaggtccgttcgccccgcgcctgacgtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatgggttccaacaaattgcaaataaaactgtatggaaacgat

SEQ ID NO: 373046 - DNA, 5002 bp, Homo sapiens
catctgaacagagatatgatgctgaattctttaagaaattcagaaatcagaatattgttctctcagcaagaacttatgctcaggaaagtaatgtacaagccctggaaattctgtttacttaccatggttccgacctgcttcctcatcgccttgcaattctgtccaactttccagagaccacttctccacatgaatattctgttttgctgcccgaagcttgttttaacggtgactccctgatgatcattccttggcatgaacataaacaccgagctaaagattggtgcgaggagttggcttgcagaatggttgttgagccgaatctccaagatgaaagtgaattcttgtatgctgcacagcctgagttactaaggttcaggatgacccagcttacggtggagaaggttatggactggtatcagaccagagcagaggaaatagagcattatgctcggcaggtggactgtgcattgtcacttattcgacttgggatggagcggaatattcctggtttgctggttctctgtgacaatttggttactctggaaacattggtttatgaagccaggtgtgatgtaactctaaccctgaaagaactccagcagatgaaagacattgaaaaactaagattactgatgaatagttgttctgaggataaatatgtgacaagtgcctaccagtggatggttccctttcttcatcgttgtgagaaacagtcgcctggtgtggctaatgagctattaaaagaatatttagtaactttagctaaaggggacttaaaatttcccctgaagatatttcagcattccaaaccagatctgcagcaaaaaattattcctgatcaggaccaactgatggcaatagcactagagtgcatctatacctgtgaacgaaatgatcaactctgtctttgctatgacctactagaatgtctgccagaaagaggatatggtgataagacagaggcaaccacaaagcttcatgacatggtagaccaactggaacaaattctcagtgtgtcagagcttttggaaaaacatggactcgagaaaccaatttcatttgttaaaaacactcaatctagctcagaagaggcacgcaagctgatggttagattgacgaggcacactggccggaagcagcctcctgtcagtgagtctcattggagaacgttgctgcaagacatgttaactatgcagcagaatgtatacacatgtctagattctgatgcctgctatgagatatttacagaaagccttctgtgctctagtcgccttgaaaacatccacctggctggacagatgatgcactgcagtgcttgttcagaaaatcctccagctggtatagcccataaagggaaaccccactacagggtcagctacgaaaagagtattgacttggttttggctgccagcagagagtacttcaattcttctaccaacctcactgatagctgcatggatctagccaggtgctgcttacaactgataacagacagaccccctgccattcaagaggagctagatcttatccaagccgttggatgtcttgaagaatttggggtaaagatcctgcctttgcaagtgcgattgtgccctgatcggatcagtctcatcaaggagtgtatttcccagtcccccacatgctataaacaatccaccaagcttctgggccttgctgagctgctgagggttgcaggtgagaacccagaagaaaggcggggacaggttctaatccttttagtggagcaggcacttcgcttccatgactacaaagcagccagtatgcattgtcaggagctgatggccacaggttatcctaaaagttgggatgtttgtagccagttaggacaatcagaaggttaccaggacttggccactcgtcaagagctcatggcttttgctttgacacattgccctcctagcagcattgaacttcttttggcagctagcagctctctgcagacagaaattctttatcaaagagtgaatttccagatccatcatgaaggaggggaaaatatcagtgcttcaccattaactagtaaagcagtacaagaggatgaagtaggtgttccaggtagcaattcagctgacctattgcgctggaccactgctaccaccatgaaagtcctttccaacaccacaaccaccaccaaagcggtgctgcaggccgtcagtgatgggcagtggtggaagaagtctttaacttaccttcgaccccttcaggggcaaaaatgtggtggtgcatatcaaatcggaactacagccaatgaagatctagagaaacaagggtgtcatcctttttatgaatctgtcatctcaaatccttttgtcgctgagtctgaagggacctatgacacctatcagcatgttccagtggaaagctttgcagaagtattgctgagaactggaaaattggcagaggctaaaaataaaggagaagtatttccaacaactgaagttctcttgcaactagcaagtgaagccttgccaaatgacatgaccttggctcttgcttaccttcttgccttaccacaagtgttagatgctaaccggtgctttgaaaagcagtccccctctgcattatctctccagctggcagcgtattactatagcctccagatctatgcccgattggccccatgtttcagggacaagtgccatcctctttacagggctgatcccaaagaactaatcaagatggtcaccaggcatgtgactcgacatgagcacgaagcctggcctgaagaccttatttcactgaccaagcagttacactgctacaatgaacgtctcctggatttcactcaggcgcagatccttcagggccttcggaagggtgtggacgtgcagcggtttactgcagatgaccagtataaaagggaaactatccttggtctggcagaaactctagaggaaagcgtctacagcattgctatttctctggcacaacgttacagtgtctcccgctgggaagtttttatgacccatttggagttcctcttcacggacagtggtttgtccacactagaaattgaaaatagagcccaagaccttcatctctttgagactttgaagactgatccagaagcctttcaccagcacatggtcaagtatatttaccctactattggtggctttgatcacgaaaggctgcagtattatttcactcttctggaaaactgtggctgtgcagatttggggaactgtgccattaaaccagaaacccacattcgactgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctgtctgtggaagcccgtaaagagatgactagaaaggctattaagacagtcaaacattttattgagaagccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaagggtgaggagctggtttcacctgaggacctgctggagtggctgcggcctttctgtgctgatgacgcctggccggtgcggccccgcattcacgtgctgcagattttggggcaatcatttcacctgactgaggaggacagcaagctcctcgtgttctttagaactgaagccattctcaaagcctcctggccccagagacaggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagaggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatgggttccaacaaattgcaaataaaactgtatggaaacgat

SEQ ID NO: 373047 - DNA, 2313 bp, Homo sapiens
catactagtctgaagcaggttaagctgtgcctcggtgatagaacctgaaagccagtgttttgtggggtttttgggtttttgtgcttttcttttgttttttcaagaaatactttattttactaattatgaaaaggaagccaaaagtgccacatgtcacgggacagtcccagtgaacgcttgtcctagttggagcactttttattaacattagcagtgtgtacttccaaagttaagtcagtatattcaaaccttccctcaatataccctggtggctgggagcaggcagatacacttcccatggcctgggacatggcccagtgtggcccggtctccctgaaggtgctccttgctcatctcttggcttcctgtcgtctgtcacacagccctgggggcatggatctggctgatgctgaggcccatggccatgagccaggaagggggaggcagggtcaggaaagggtagaggcacacctctcagtacgctgaataccactgccagtctccctggcacccaccagaactggtccattgtcatcagagagtaaagtttgtactgggagttactgacaaacagttgctaatacaaaaagtcccatgtgaaattttctttgtttcaggccgagggggcccaggacctgctcagagagtgcccaaatctgggcgttccagctccttagacggagagcaccacgatggataccacagagaccctgaactcttttctgggcacctgaatcccaggaaccctcaatgaggtcttcaagatgaagagactgctgccagctaccagcctggctggccctgtcctgtccaccctcattgccccaactcccatgttgttttgtgaagataaaagctgggatctttttcttttttttaagtctcacaagacatggggcatctccacaaatttaagttcctgtccatttggaaatttgtttctatgtgtacagtttgtcagagaaaaacaaagtttttgtatgaatacagaatgtgatttacgcaagaattgacagaaaactagttgtgaagtgcttgccttaaggaaacctttggtttccatcgcatcccatctgccaaggaatgcacggttgttgctgatgttcatgagcatattaaccactaggttatctaaattaatctcagctgtgaactttgtgtttttcaacacattctgtcacaccatttttgtgacagaaaaatacttgaaaattattctaatgtagtttgtagtaggttcaaatttttattcagacatgctctgacagatggaaaattgtactctgaagagaaaatgcaatcttctggatgtccaacgagggagcttccccttggaagcatctcctaagaatcacagtttaggtttgaatcgccttgttatgatgaggagaggaacttgatgttagtcagaaataaagtcacatgccctttagataacttgaaatcacacatggagttgataaggaatggaccaaaataggtcctcaaacaattttgcaacacttaattaagttttcctctcttcctcttccatactatgtggaaataccagtgttacggcagggcgtacttctaactcacagtaagccagatagatcttgtccatggcaaattccttgtttaaaataaacataccatttagcccagtttggattggaagccaaaaattcagtttgttatataccccatgatactttctatactgacctttattttggttttacatggaagcttttattaaaaggactgtcctatggccaccttaacatttcattacattggcagcttcagttttggcatcagtcaaatttatttggcaaatttagtggtgctggaagtttctttttttcttttccttttttgacagagtcttgctctgtcacccagccaggagtgcagtggtgcaatcacggctcacttcagctttgaccctgcctcagcctccctagtagctaggactacaggcatatgccaccatgcccagctaattttttgtgtgtgtgttttttgtagagatggagtttcaccactttgtctatgctggtttcaaactcctgggctcaagcggtccacctgctgtggcctcccaaagtgctgggattgcagatctgagccacagtacctggccgctggtgctggaagtttcaatggttgcttagaaaaggcatactgatatagtttaacaggatatgaaaatttaactggttctctatgaatgtaaaaaacagcaaaagctaattgatttctgtggagtgagaaaatgtcagccatatacactgcttttcagtgttagaatcgtcgacgcagactatt

SEQ ID NO: 373048 - DNA, 7588 bp, Homo sapiens
tcccgccagtgcgtgatgacccggagagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccaggtttatacacaatataccattttctgtagtccctattgtcatggttaaattattctctaagtgtattctgggtgcagagatgcatgggctctgtcagtttctgggaaactttctgcaccctataaacacaatatttttctttgttttcacacattcaccattttgctggcacctttctgaagtagtgttgtcccggtatcagcctttgcaatatgttagagatgtactgtctgccgcattttgcactggttttctcttttcatttatgattaataatgtgtatacgttattcctttttattatctactgtgtaagacaagaatatttcattccaaataaagaattcagtctttaattatgcaactgaataaaatctaaagcctacagaaaacaacttcagaattcacacaaagtggaaaaaggcttaagtgaagacctggttggcttggttatgccacgacttccaaaggaaagtataggactaaaaccctcacagataactggatgtggcaaacattaacggagtaatgaatgggttcttcaagctttgcagctgtaagcagatcattgtcaagaagactctaggacttttcttctgattcactgttgataacatcacttatgcaaatgtatacaataagtggagtttaaaatattttcagtgagttgtatatttttacacatcagtgaggtatgtatagtaaaactgggggaaaaagttccaaatacaagcctgaagaattgctgcagcctcagaataaagctaagcagcattctttaaggttgtgccacccatgtgtgggaggaggttgacatctttatggaaacatcatccactgtagtcatttgttcatactttcagaatcttaacagaaattgttggatgaacatgcttctgctttgtagattttgccttagtgtcatgcccatacattgagtttacacagctggtccttcataggattccaaagttcaagggagtttttagagttagttgagaaacttgatgatctttcactgctgggaaaaactgactccttcttgcagcagattctttggctttacacacaagtctgaatgtccttattttaaagttttcctcaaaggtgcaacattcatggaatagcttgccaggaagatgtgaaacttttctacagacctttgaaatggatgagaaacattgtatgtagggatgtttagcaatcagtcttttaatagacagcccacattgtttcagcttatttcatgaagtgtctgaggcagaagctgatgataattttgggagcagtattcgtgtgtgatttaaaagactgcaggaatactgcaaaaatagaatccatttattttcaccacttaaggcagcttcatgtgatttcctcgtatcatagaaaatagagaaggaacatggatagcattagcactaataatacacacttgaagttctcagaatactgatgattgaaaactcaaacaactgctctgttgaagtcttcttttgatgagatgcctatgttagctgacgacattcactttaagggcttcttcactggattcttccctctcctgtttataatgcagcacagtgtttttatttttccctgtctgagaagcacagattatctgttaaatgctgacttctttcccctgctgtgtgtcttcatgtaacagtttctcacccacggataataaatttgctacatgctctgatgacggcactgttagaatctgggactttcttcgttgccatgaggaaagaattctccgagggcatggtgctgatgtgaaatgtgtagactggcatccaaccaaagggttagttgtttcaggaagtaaagatagtcaacagccaatcaagttctgggatcccaagactgggcagagtcttgcaacacttcatgcccataaaaacacagtaatggaagtgaaattaaacctcaatggcaattggctactcacagcatcacgtgatcatctctgtaaactttttgatatcagaaacctaaaagaagagcttcaagtcttccgaggtcataagaaagaagccacagctgtggcctggcatcctgttcatgaaggactttttgccagtggagggtctgatggttctttgttattctggcatgttggggtagagaaggaagtgggtgggatggagatggctcacgaagggatgatctggagtctggcttggcatcctcttgggcatattctctgctcaggctcaaatgaccatactagcaaattctggactcgaaaccgaccaggtgataaaatgcgagatcgatataatctaaaccttttacctggaatgtctgaagatggagtagaatatgatgacctcgaacctaatagcctggcagtaattccaggaatgggaataccagaacaactaaaattagctatggaacaagaacagatggggaaagatgaatcaaatgaaattgaaatgacaattccaggtttagattggggaatggaggaagtgatgcaaaaggatcagaaaaaagtacctcagaagaaagttccttatgcaaaacccattcctgctcagttccagcaggcttggatgcaaaataaagttccaattcctgctccaaatgaggtgctgaatgacagaaaagaagacattaaattggaagagaagaaaaaaacacaagcagaaattgagcaagaaatggctacattacaatatactaacccacaacttctggagcaacttaaaattgaaagacttgcacagaaacaagttgagcaaattcagcctcctccctcatctggcacccctctcctcggaccccagccttttccaggacaaggtccaatgtctcagattcctcaaggttttcaacagccccatccatctcagcagatgccaatgaacatggctcaaatggggcctccaggtccacagggacagtttaggcctcctggaccccagggacaaatgggaccacaaggtcctccactgcatcagggaggtggggggccacaaggattcatgggaccacaggggccccagggcccgccccaggggttgccacggcctcaggacatgcatgggccccaaggaatgcagaggcatcctggacctcatggccctttgggacctcaagggccacctggaccacaaggtagttctggtcctcaaggtcatatgggtcctcagggtccacctggcccacagggtcacataggcccccaaggcccgcctggccctcagggtcacttgggcccacaggggcctccgggtactcaaggtatgcagggaccacctggtcccagaggaatgcaagggcctcctcatcctcatgggatccaaggcggaccagggtctcaagggatccaaggtcctgtgtctcagggacctctgatgggattgaatccaagaggaatgcaggggcctccaggcccccgggagaaccagggtcctgctccccaagggatgattatgggccacccgcctcaagagatgagaggacctcaccctccaggtggactactgggacacggccctcaggaaatgagaggtcctcaggagatccgaggcatgcaggggcctccaccccaaggatcaatgctgggacctccccaggaattgcgagggcctccaggctcacaaagtcagcaggggccgccccagggctctttaggacctccaccccagggtggcatgcaaggaccccccggacctcagggacagcagaacccagcaagagggccacatccatctcaagggccaataccattccagcaacagaaaacgcctctgctaggtgatgggccccgggcccccttcaaccaggaaggacagagcacaggccccccacccctgataccaggcctagggcagcagggagcacaaggtcgcattccccctctgaaccccggacaaggacctggccccaacaaaggtgactcccgcggccctccaaaccatcacatgggcccgatgtcagagaggcggcatgagcagagcggcgggcctgagcatgggcccgagagggggcctttccggggtggccaggactgcaggggtccccctgataggcgtggccctcacccagacttccccgatgacttcagcagaccagatgacttccaccctgacaagcgctttggccaccggttacgtgaatttgaggggcgaggaggacctttaccgcaagaagagaagtggaggcgagggggccctgggcctccgtttccccctgatcacagggaattcagcgagggggatggccggggtgcagcccgaggccctccgggggcatgggaaggccgcaggcccggagatgaacgtttcccccgggatcccgaggacccacgttttcgagggcgcagagaagaaagtttcagaagaggagccccgccgaggcatgagggccgtgctccccccagaggaagggatggttttcctggtcctgaagactttggtccagaggagaattttgatgcttctgaggaagcggcccgaggacgagatctcagaggtcgaggtcggggtaccccacgaggaggaaggaagggtttacttcccactcctgacgagttccctcgctttgaaggagggcggaagccagattcctgggatggaaacagagagcctgggccaggtcatgaacattttcgtgatactccccgccctgatcatccccctcacgacggtcattccccagccagcagagaacgctcctcttctctccaaggcatggacatggcatccctacctccccgaaagcgcccctggcatgatggcccaggcacttctgagcacagagagatggaggccccaggaggcccttctgaagaccgaggaggcaaaggccgagggggcccaggacctgctcagagagtgcccaaatctgggcgttccagctccttagacggagagcaccacgatggataccacagagatgaaccttttgggggccctccaggcagtggcaccccttctcgagggggccggagtggcagtaactggggtagagggagtaacatgaactctggcccgccgaggcgaggagcttcacggggtggtggaaggggtcggtagaagctggaactgagtaccctgaggcctctctggacagtatgtaagaacttcttgtggactcaccaagagaaacaaaaggaagcctgcaccattgtagccctgaactcttttctgggcacctgaatcccaggaaccctcaatgaggtcttcaagatgaagagactgctgccagctaccagcctggctggccctgtcctgtccaccctcattgccccaactcccatgttgttttgtgaagataaaagctgggatctttttcttttttttaagtctcacaagacatggggcatctccacaaatttaagttcctgtccatttggaaatttgtttctatgtgtacagtttgtcagagaaaaacaaagtttttgtatgaatacagaatgtgatttacgcaagaattgacagaaaactagttgtgaagtgcttgccttaaggaaacctttggtttccatcgcatcccatctgccaaggaatgcacggttgttgctgatgttcatgagcatattaaccactaggttatctaaattaatctcagctgtgaactttgtgtttttcaacacattctgtcacaccatttttgtgacagaaaaatacttgaaaattattctaatgtagtttgtagtaggttcaaatttttattcagacatgctctgacagatggaaaattgtactctgaagagaaaatgcaatcttctggatgtccaacgagggagcttccccttggaagcatctcctaagaatcacagtttaggtttgaatcgccttgttatgatgaggagaggaacttgatgttagtcagaaataaagtcacatgccctttagataacttgaaatcacacatggagttgataaggaatggaccaaaataggtcctcaaacaattttgcaacacttaattaagttttcctctcttcctcttccatactatgtggaaataccagtgttacggcagggcgtacttctaactcacagtaagccagatagatcttgtccatggcaaattccttgtttaaaataaacataccatttagcccagtttggattggaagccaaaaattcagtttgttatataccccatgatactttctatactgacctttattttggttttacatggaagcttttattaaaaggactgtcctatggccaccttaacatttcattacattggcagcttcagttttggcatcagtcaaatttatttggcaaatttagtggtgctggaagtttctttttttcttttccttttttgacagagtcttgctctgtcacccagccaggagtgcagtggtgcaatcacggctcacttcagctttgaccctgcctcagcctccctagtagctaggactacaggcatatgccaccatgcccagctaattttttgtgtgtgtgttttttgtagagatggagtttcaccactttgtctatgctggtttcaaactcctgggctcaagcggtccacctgctgtggcctcccaaagtgctgggattgcagatctgagccacagtacctggccgctggtgctggaagtttcaatggttgcttagaaaaggcatactgatatagtttaacaggatatgaaaatttaactggttctctatgaatgtaaaaaacagcaaaagctaattgatttctgtggagtgagaaaatgtcagccatatacactgcttttcagtgttagaatcgtcgacgcagactatt

SEQ ID NO: 373049 - DNA, 6288 bp, Homo sapiens
tcccgccagtgcgtgatgacccggagagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccaggtttatacacaatataccattttctgtagtccctattgtcatggttaaattattctctaagtgtattctgggtgcagagatgcatgggctctgtcagtttctgggaaactttctgcaccctataaacacaatatttttctttgttttcacacattcaccattttgctggcacctttctgaagtagtgttgtcccggtatcagcctttgcaatatgttagagatgtactgtctgccgcattttgcactggttttctcttttcatttatgattaataatgtgtatacgttattcctttttattatctactgtgtaagacaagaatatttcattccaaataaagaattcagtctttaattatgcaactgaataaaatctaaagcctacagaaaacaacttcagaattcacacaaagtggaaaaaggcttaagtgaagacctggttggcttggttatgccacgacttccaaaggaaagtataggactaaaaccctcacagataactggatgtggcaaacattaacggagtaatgaatgggttcttcaagctttgcagctgtaagcagatcattgtcaagaagactctaggacttttcttctgattcactgttgataacatcacttatgcaaatgtatacaataagtggagtttaaaatattttcagtgagttgtatatttttacacatcagtgaggtatgtatagtaaaactgggggaaaaagttccaaatacaagcctgaagaattgctgcagcctcagaataaagctaagcagcattctttaaggttgtgccacccatgtgtgggaggaggttgacatctttatggaaacatcatccactgtagtcatttgttcatactttcagaatcttaacagaaattgttggatgaacatgcttctgctttgtagattttgccttagtgtcatgcccatacattgagtttacacagctggtccttcataggattccaaagttcaagggagtttttagagttagttgagaaacttgatgatctttcactgctgggaaaaactgactccttcttgcagcagattctttggctttacacacaagtctgaatgtccttattttaaagttttcctcaaaggtgcaacattcatggaatagcttgccaggaagatgtgaaacttttctacagacctttgaaatggatgagaaacattgtatgtagggatgtttagcaatcagtcttttaatagacagcccacattgtttcagcttatttcatgaagtgtctgaggcagaagctgatgataattttgggagcagtattcgtgtgtgatttaaaagactgcaggaatactgcaaaaatagaatccatttattttcaccacttaaggcagcttcatgtgatttcctcgtatcatagaaaatagagaaggaacatggatagcattagcactaataatacacacttgaagttctcagaatactgatgattgaaaactcaaacaactgctctgttgaagtcttcttttgatgagatgcctatgttagctgacgacattcactttaagggcttcttcactggattcttccctctcctgtttataatgcagcacagtgtttttatttttccctgtctgagaagcacagattatctgttaaatgctgacttctttcccctgctgtgtgtcttcatgtaacagtttctcacccacggataataaatttgctacatgctctgatgacggcactgttagaatctgggactttcttcgttgccatgaggaaagaattctccgagggcatggtgctgatgtgaaatgtgtagactggcatccaaccaaagggttagttgtttcaggaagtaaagatagtcaacagccaatcaagttctgggatcccaagactgggcagagtcttgcaacacttcatgcccataaaaacacagtaatggaagtgaaattaaacctcaatggcaattggctactcacagcatcacgtgatcatctctgtaaactttttgatatcagaaacctaaaagaagagcttcaagtcttccgaggtcataagaaagaagccacagctgtggcctggcatcctgttcatgaaggactttttgccagtggagggtctgatggttctttgttattctggcatgttggggtagagaaggaagtgggtgggatggagatggctcacgaagggatgatctggagtctggcttggcatcctcttgggcatattctctgctcaggctcaaatgaccatactagcaaattctggactcgaaaccgaccaggtgataaaatgcgagatcgatataatctaaaccttttacctggaatgtctgaagatggagtagaatatgatgacctcgaacctaatagcctggcagtaattccaggaatgggaataccagaacaactaaaattagctatggaacaagaacagatggggaaagatgaatcaaatgaaattgaaatgacaattccaggtttagattggggaatggaggaagtgatgcaaaaggatcagaaaaaagtacctcagaagaaagttccttatgcaaaacccattcctgctcagttccagcaggcttggatgcaaaataaagttccaattcctgctccaaatgaggtgctgaatgacagaaaagaagacattaaattggaagagaagaaaaaaacacaagcagaaattgagcaagaaatggctacattacaatatactaacccacaacttctggagcaacttaaaattgaaagacttgcacagaaacaagttgagcaaattcagcctcctccctcatctggcacccctctcctcggaccccagccttttccaggacaaggtccaatgtctcagattcctcaaggttttcaacagccccatccatctcagcagatgccaatgaacatggctcaaatggggcctccaggtccacagggacagtttaggcctcctggaccccagggacaaatgggaccacaaggtcctccactgcatcagggaggtggggggccacaaggattcatgggaccacaggggccccagggcccgccccaggggttgccacggcctcaggacatgcatgggccccaaggaatgcagaggcatcctggacctcatggccctttgggacctcaagggccacctggaccacaaggtagttctggtcctcaaggtcatatgggtcctcagggtccacctggcccacagggtcacataggcccccaaggcccgcctggccctcagggtcacttgggcccacaggggcctccgggtactcaaggtatgcagggaccacctggtcccagaggaatgcaagggcctcctcatcctcatgggatccaaggcggaccagggtctcaagggatccaaggtcctgtgtctcagggacctctgatgggattgaatccaagaggaatgcaggggcctccaggcccccgggagaaccagggtcctgctccccaagggatgattatgggccacccgcctcaagagatgagaggacctcaccctccaggtggactactgggacacggccctcaggaaatgagaggtcctcaggagatccgaggcatgcaggggcctccaccccaaggatcaatgctgggacctccccaggaattgcgagggcctccaggctcacaaagtcagcaggggccgccccagggctctttaggacctccaccccagggtggcatgcaaggaccccccggacctcagggacagcagaacccagcaagagggccacatccatctcaagggccaataccattccagcaacagaaaacgcctctgctaggtgatgggccccgggcccccttcaaccaggaaggacagagcacaggccccccacccctgataccaggcctagggcagcagggagcacaaggtcgcattccccctctgaaccccggacaaggacctggccccaacaaaggtgactcccgcggccctccaaaccatcacatgggcccgatgtcagagaggcggcatgagcagagcggcgggcctgagcatgggcccgagagggggcctttccggggtggccaggactgcaggggtccccctgataggcgtggccctcacccagacttccccgatgacttcagcagaccagatgacttccaccctgacaagcgctttggccaccggttacgtgaatttgaggggcgaggaggacctttaccgcaagaagagaagtggaggcgagggggccctgggcctccgtttccccctgatcacagggaattcagcgagggggatggccggggtgcagcccgaggccctccgggggcatgggaaggccgcaggcccggagatgaacgtttcccccgggatcccgaggacccacgttttcgagggcgcagagaagaaagtttcagaagaggagccccgccgaggcatgagggccgtgctccccccagaggaagggatggttttcctggtcctgaagactttggtccagaggagaattttgatgcttctgaggaagcggcccgaggacgagatctcagaggtcgaggtcggggtaccccacgaggaggaaggaagggtttacttcccactcctgacgagttccctcgctttgaaggagggcggaagccagattcctgggatggaaacagagagcctgggccaggtcatgaacattttcgtgatactccccgccctgatcatccccctcacgacggtcattccccagccagcagagaacgctcctcttctctccaaggcatggacatggcatccctacctccccgaaagcgcccctggcatgatggcccaggcacttctgagcacagagagatggaggccccaggaggcccttctgaagaccgaggaggcaaaggccgagggggcccaggacctgctcagagagtgcccaaatctgggcgttccagctccttagacggagagcaccacgatggataccacagagatgaaccttttgggggccctccaggcagtggcaccccttctcgagggggccggagtggcagtaactggggtagagggagtaacatgaactctggcccgccgaggcgaggagcttcacggggtggtggaaggggtcggtagaagctggaactgagtaccctgaggcctctctggacagtatgtaagaacttcttgtggactcaccaagagaaacaaaaggaagcctgcaccattgtagccctgaactcttttctgggcacctgaatcccaggaaccctcaatgaggtcttcaagatgaagagactgctgccagctaccagcctggctggccctgtcctgtccaccctcattgccccaactcccatgttgttttgtgaagataaaagctgggatctttttcttttttttaagtctcacaagacatggggcatctccacaaatttaagttcctgtccatttggaaatttgtttctatgtgtacagtttgtcagagaaaaacaaagtttttgtatgaatacagaatgtgatttacgcaagaattga

SEQ ID NO: 373050 - DNA, 7209 bp, Homo sapiens
tcccgccagtgcgtgatgacccggagagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccaggtttatacacaatataccattttctgtagtccctattgtcatggttaaattattctctaagtgtattctgggtgcagagatgcatgggctctgtcagtttctgggaaactttctgcaccctataaacacaatatttttctttgttttcacacattcaccattttgctggcacctttctgaagtagtgttgtcccggtatcagcctttgcaatatgttagagatgtactgtctgccgcattttgcactggttttctcttttcatttatgattaataatgtgtatacgttattcctttttattatctactgtgtaagacaagaatatttcattccaaataaagaattcagtctttaattatgcaactgaataaaatctaaagcctacagaaaacaacttcagaattcacacaaagtggaaaaaggcttaagtgaagacctggttggcttggttatgccacgacttccaaaggaaagtataggactaaaaccctcacagataactggatgtggcaaacattaacggagtaatgaatgggttcttcaagctttgcagctgtaagcagatcattgtcaagaagactctaggacttttcttctgattcactgttgataacatcacttatgcaaatgtatacaataagtggagtttaaaatattttcagtgagttgtatatttttacacatcagtgaggtatgtatagtaaaactgggggaaaaagttccaaatacaagcctgaagaattgctgcagcctcagaataaagctaagcagcattctttaaggttgtgccacccatgtgtgggaggaggttgacatctttatggaaacatcatccactgtagtcatttgttcatactttcagaatcttaacagaaattgttggatgaacatgcttctgctttgtagattttgccttagtgtcatgcccatacattgagtttacacagctggtccttcataggattccaaagttcaagggagtttttagagttagttgagaaacttgatgatctttcactgctgggaaaaactgactccttcttgcagcagattctttggctttacacacaagtctgaatgtccttattttaaagttttcctcaaaggtgcaacattcatggaatagcttgccaggaagatgtgaaacttttctacagacctttgaaatggatgagaaacattgtatgtagggatgtttagcaatcagtcttttaatagacagcccacattgtttcagcttatttcatgaagtgtctgaggcagaagctgatgataattttgggagcagtattcgtgtgtgatttaaaagactgcaggaatactgcaaaaatagaatccatttattttcaccacttaaggcagcttcatgtgatttcctcgtatcatagaaaatagagaaggaacatggatagcattagcactaataatacacacttgaagttctcagaatactgatgattgaaaactcaaacaactgctctgttgaagtcttcttttgatgagatgcctatgttagctgacgacattcactttaagggcttcttcactggattcttccctctcctgtttataatgcagcacagtgtttttatttttccctgtctgagaagcacagattatctgttaaatgctgacttctttcccctgctgtgtgtcttcatgtaacagtttctcacccacggataataaatttgctacatgctctgatgacggcactgttagaatctgggactttcttcgttgccatgaggaaagaattctccgagggcatggtgctgatgtgaaatgtgtagactggcatccaaccaaagggttagttgtttcaggaagtaaagatagtcaacagccaatcaagttctgggatcccaagactgggcagagtcttgcaacacttcatgcccataaaaacacagtaatggaagtgaaattaaacctcaatggcaattggctactcacagcatcacgtgatcatctctgtaaactttttgatatcagaaacctaaaagaagagcttcaagtcttccgaggtcataagaaagaagccacagctgtggcctggcatcctgttcatgaaggactttttgccagtggagggtctgatggttctttgttattctggcatgttggggtagagaaggaagtgggtgggatggagatggctcacgaagggatgatctggagtctggcttggcatcctcttgggcatattctctgctcaggctcaaatgaccatactagcaaattctggactcgaaaccgaccaggtgataaaatgcgagatcgatataatctaaaccttttacctggaatgtctgaagatggagtagaatatgatgacctcgaacctaatagcctggcagtaattccaggaatgggaataccagaacaactaaaattagctatggaacaagaacagatggggaaagatgaatcaaatgaaattgaaatgacaattccaggtttagattggggaatggaggaagtgatgcaaaaggatcagaaaaaagtacctcagaagaaagttccttatgcaaaacccattcctgctcagttccagcaggcttggatgcaaaataaagttccaattcctgctccaaatgaggtgctgaatgacagaaaagaagacattaaattggaagagaagaaaaaaacacaagcagaaattgagcaagaaatggctacattacaatatactaacccacaacttctggagcaacttaaaattgaaagacttgcacagaaacaagttgagcaaattcagcctcctccctcatctggcacccctctcctcggaccccagccttttccaggacaaggtccaatgtctcagattcctcaaggttttcaacagccccatccatctcagcagatgccaatgaacatggctcaaatggggcctccaggtccacagggacagtttaggcctcctggaccccagggacaaatgggaccacaaggtcctccactgcatcagggaggtggggggccacaaggattcatgggaccacaggggccccagggcccgccccaggggttgccacggcctcaggacatgcatgggccccaaggaatgcagaggcatcctggacctcatggccctttgggacctcaagggccacctggaccacaaggtagttctggtcctcaaggtcatatgggtcctcagggtccacctggcccacagggtcacataggcccccaaggcccgcctggccctcagggtcacttgggcccacaggggcctccgggtactcaaggtatgcagggaccacctggtcccagaggaatgcaagggcctcctcatcctcatgggatccaaggcggaccagggtctcaagggatccaaggtcctgtgtctcagggacctctgatgggattgaatccaagaggaatgcaggggcctccaggcccccgggagaaccagggtcctgctccccaagggatgattatgggccacccgcctcaagagatgagaggacctcaccctccaggtggactactgggacacggccctcaggaaatgagaggtcctcaggagatccgaggcatgcaggggcctccaccccaaggatcaatgctgggacctccccaggaattgcgagggcctccaggctcacaaagtcagcaggggccgccccagggctctttaggacctccaccccagggtggcatgcaaggaccccccggacctcagggacagcagaacccagcaagagggccacatccatctcaagggccaataccattccagcaacagaaaacgcctctgctaggtgatgggccccgggcccccttcaaccaggaaggacagagcacaggccccccacccctgataccagggaattcagcgagggggatggccggggtgcagcccgaggccctccgggggcatgggaaggccgcaggcccggagatgaacgtttcccccgggatcccgaggacccacgttttcgagggcgcagagaagaaagtttcagaagaggagccccgccgaggcatgagggccgtgctccccccagaggaagggatggttttcctggtcctgaagactttggtccagaggagaattttgatgcttctgaggaagcggcccgaggacgagatctcagaggtcgaggtcggggtaccccacgaggaggaaggaagggtttacttcccactcctgacgagttccctcgctttgaaggagggcggaagccagattcctgggatggaaacagagagcctgggccaggtcatgaacattttcgtgatactccccgccctgatcatccccctcacgacggtcattccccagccagcagagaacgctcctcttctctccaaggcatggacatggcatccctacctccccgaaagcgcccctggcatgatggcccaggcacttctgagcacagagagatggaggccccaggaggcccttctgaagaccgaggaggcaaaggccgagggggcccaggacctgctcagagagtgcccaaatctgggcgttccagctccttagacggagagcaccacgatggataccacagagatgaaccttttgggggccctccaggcagtggcaccccttctcgagggggccggagtggcagtaactggggtagagggagtaacatgaactctggcccgccgaggcgaggagcttcacggggtggtggaaggggtcggtagaagctggaactgagtaccctgaggcctctctggacagtatgtaagaacttcttgtggactcaccaagagaaacaaaaggaagcctgcaccattgtagccctgaactcttttctgggcacctgaatcccaggaaccctcaatgaggtcttcaagatgaagagactgctgccagctaccagcctggctggccctgtcctgtccaccctcattgccccaactcccatgttgttttgtgaagataaaagctgggatctttttcttttttttaagtctcacaagacatggggcatctccacaaatttaagttcctgtccatttggaaatttgtttctatgtgtacagtttgtcagagaaaaacaaagtttttgtatgaatacagaatgtgatttacgcaagaattgacagaaaactagttgtgaagtgcttgccttaaggaaacctttggtttccatcgcatcccatctgccaaggaatgcacggttgttgctgatgttcatgagcatattaaccactaggttatctaaattaatctcagctgtgaactttgtgtttttcaacacattctgtcacaccatttttgtgacagaaaaatacttgaaaattattctaatgtagtttgtagtaggttcaaatttttattcagacatgctctgacagatggaaaattgtactctgaagagaaaatgcaatcttctggatgtccaacgagggagcttccccttggaagcatctcctaagaatcacagtttaggtttgaatcgccttgttatgatgaggagaggaacttgatgttagtcagaaataaagtcacatgccctttagataacttgaaatcacacatggagttgataaggaatggaccaaaataggtcctcaaacaattttgcaacacttaattaagttttcctctcttcctcttccatactatgtggaaataccagtgttacggcagggcgtacttctaactcacagtaagccagatagatcttgtccatggcaaattccttgtttaaaataaacataccatttagcccagtttggattggaagccaaaaattcagtttgttatataccccatgatactttctatactgacctttattttggttttacatggaagcttttattaaaaggactgtcctatggccaccttaacatttcattacattggcagcttcagttttggcatcagtcaaatttatttggcaaatttagtggtgctggaagtttctttttttcttttccttttttgacagagtcttgctctgtcacccagccaggagtgcagtggtgcaatcacggctcacttcagctttgaccctgcctcagcctccctagtagctaggactacaggcatatgccaccatgcccagctaattttttgtgtgtgtgttttttgtagagatggagtttcaccactttgtctatgctggtttcaaactcctgggctcaagcggtccacctgctgtggcctcccaaagtgctgggattgcagatctgagccacagtacctggccgctggtgctggaagtttcaatggttgcttagaaaaggcatactgatatagtttaacaggatatgaaaatttaactggttctctatgaatgtaaaaaacagcaaaagctaattgatttctgtggagtgagaaaatgtcagccatatacactgcttttcagtgttagaatcgtcgacgcagactatt

SEQ ID NO: 373051 - DNA, 3157 bp, Homo sapiens
tcccgccagtgcgtgatgacccggagagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccaggtttatacacaatataccattttctgtagtccctattgtcatggttaaattattctctaagtgtattctgggtgcagagatgcatgggctctgtcagtttctgggaaactttctgcaccctataaacacaatatttttctttgttttcacacattcaccattttgctggcacctttctgaagtagtgttgtcccggtatcagcctttgcaatatgttagagatgtactgtctgccgcattttgcactggttttctcttttcatttatgattaataatgtgtatacgttattcctttttattatctactgtgtaagacaagaatatttcattccaaataaagaattcagtctttaattatgcaactgaataaaatctaaagcctacagaaaacaacttcagaattcacacaaagtggaaaaaggcttaagtgaagacctggttggcttggttatgccacgacttccaaaggaaagtataggactaaaaccctcacagataactggatgtggcaaacattaacggagtaatgaatgggttcttcaagctttgcagctgtaagcagatcattgtcaagaagactctaggacttttcttctgattcactgttgataacatcacttatgcaaatgtatacaataagtggagtttaaaatattttcagtgagttgtatatttttacacatcagtgaggtatgtatagtaaaactgggggaaaaagttccaaatacaagcctgaagaattgctgcagcctcagaataaagctaagcagcattctttaaggttgtgccacccatgtgtgggaggaggttgacatctttatggaaacatcatccactgtagtcatttgttcatactttcagaatcttaacagaaattgttggatgaacatgcttctgctttgtagattttgccttagtgtcatgcccatacattgagtttacacagctggtccttcataggattccaaagttcaagggagtttttagagttagttgagaaacttgatgatctttcactgctgggaaaaactgactccttcttgcagcagattctttggctttacacacaagtctgaatgtccttattttaaagttttcctcaaaggtgcaacattcatggaatagcttgccaggaagatgtgaaacttttctacagacctttgaaatggatgagaaacattgtatgtagggatgtttagcaatcagtcttttaatagacagcccacattgtttcagcttatttcatgaagtgtctgaggcagaagctgatgataattttgggagcagtattcgtgtgtgatttaaaagactgcaggaatactgcaaaaatagaatccatttattttcaccacttaaggcagcttcatgtgatttcctcgtatcatagaaaatagagaaggaacatggatagcattagcactaataatacacacttgaagttctcagaatactgatgattgaaaactcaaacaactgctctgttgaagtcttcttttgatgagatgcctatgttagctgacgacattcactttaagggcttcttcactggattcttccctctcctgtttataatgcagcacagtgtttttatttttccctgtctgagaagcacagattatctgttaaatgctgacttctttcccctgctgtgtgtcttcatgtaacagtttctcacccacggataataaatttgctacatgctctgatgacggcactgttagaatctgggactttcttcgttgccatgaggaaagaattctccgaggtacgtgtactaacagtactgattggaatatttaaatagggaagacatttgtggttaaatcatcacaaaaccacaatactggcttacacctccattcaattttttttacatatacacaccgtctcaggctcttcaaaaaaacccagcactttctctgactcacagtcattttgtaggtttttactaccagtgttatctttgaatttttcagctgtaaattaaatacaagagtgcctcccccttacttgcttatctgtatgcatcttttagggctgtattccttttccttccttgtagccagggtacttgttcccaacatattgacactgtggtttgatttagatagccgtcattctcctggcagtccttttacaatatgaattaaccgacaagatagaggtatcaaagctacacttcttagtgttactatttttgaaagcagttggtttttcagtacaccacatttgtactacatggccggcttgttactaagttcgggtggcattgctgcttgtttacttttgttgattttataattaataaacctctatgaaatta

SEQ ID NO: 373052 - DNA, 3114 bp, Homo sapiens
tcccgccagtgcgtgatgacccggagagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccaggtttatacacaatataccattttctgtagtccctattgtcatggttaaattattctctaagtgtattctgggtgcagagatgcatgggctctgtcagtttctgggaaactttctgcaccctataaacacaatatttttctttgttttcacacattcaccattttgctggcacctttctgaagtagtgttgtcccggtatcagcctttgcaatatgttagagatgtactgtctgccgcattttgcactggttttctcttttcatttatgattaataatgtgtatacgttattcctttttattatctactgtgtaagacaagaatatttcattccaaataaagaattcagtctttaattatgcaactgaataaaatctaaagcctacagaaaacaacttcagaattcacacaaagtggaaaaaggcttaagtgaagacctggttggcttggttatgccacgacttccaaaggaaagtataggactaaaaccctcacagataactggatgtggcaaacattaacggagtaatgaatgggttcttcaagctttgcagctgtaagcagatcattgtcaagaagactctaggacttttcttctgattcactgttgataacatcacttatgcaaatgtatacaataagtggagtttaaaatattttcagtgagttgtatatttttacacatcagtgaggtatgtatagtaaaactgggggaaaaagttccaaatacaagcctgaagaattgctgcagcctcagaataaagctaagcagcattctttaaggttgtgccacccatgtgtgggaggaggttgacatctttatggaaacatcatccactgtagtcatttgttcatactttcagaatcttaacagaaattgttggatgaacatgcttctgctttgtagattttgccttagtgtcatgcccatacattgagtttacacagctggtccttcataggattccaaagttcaagggagtttttagagttagttgagaaacttgatgatctttcactgctgggaaaaactgactccttcttgcagcagattctttggctttacacacaagtctgaatgtccttattttaaagttttcctcaaaggtgcaacattcatggaatagcttgccaggaagatgtgaaacttttctacagacctttgaaatggatgagaaacattgtatgtagggatgtttagcaatcagtcttttaatagacagcccacattgtttcagcttatttcatgaagtgtctgaggcagaagctgatgataattttgggagcagtattcgtgtgtgatttaaaagactgcaggaatactgcaaaaatagaatccatttattttcaccacttaaggcagcttcatgtgatttcctcgtatcatagaaaatagagaaggaacatggatagcattagcactaataatacacacttgaagttctcagaatactgatgattgaaaactcaaacaactgctctgttgaagtcttcttttgatgagatgcctatgttagctgacgacattcactttaagggcttcttcactggattcttccctctcctgtttataatgcagcacagtgtttttatttttccctgtctgagaagcacagattatctgttaaatgctgacttctttcccctgctgtgtgtcttcatgtaacagtttctcacccacggataataaatttgctacatgctctgatgacggcactgttagaatctgggactttcttcgttgccatgaggaaagaattctccgagggcatggtgctgatgtgaaatgtgtagactggcatccaaccaaagggttagttgtttcaggaagtaaagatagtcaacagccaatcaagttctgggatcccaagactgggcagagtcttgcaacacttcatgcccataaaaacacagtaatggaagtgaaattaaacctcaatggcaattggctactcacagcatcacgtgatcatctctgtaaactttttgatatcagaaacctaaaagaagagcttcaagtcttccgaggtcataagaaagaagccacagctgtggcctggcatcctgttcatgaaggactttttgccagtggagggtctgatggttctttgttattctggcatgttgggtatgtaagatttatgtgaaaaagtagtgtattttgtgaagagagcacgtgaatgtgtgcagacatgatagttttgtagcttttctaagtgttcatatatcctatatcagagactgcttgcagttttcagttctgtaaatccagcttggaatag

SEQ ID NO: 373053 - DNA, 7518 bp, Homo sapiens
tcccgccagtgcgtgatgacccggagagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccaggtttatacacaatataccattttctgtagtccctattgtcatggttaaattattctctaagtgtattctgggtgcagagatgcatgggctctgtcagtttctgggaaactttctgcaccctataaacacaatatttttctttgttttcacacattcaccattttgctggcacctttctgaagtagtgttgtcccggtatcagcctttgcaatatgttagagatgtactgtctgccgcattttgcactggttttctcttttcatttatgattaataatgtgtatacgttattcctttttattatctactgtgtaagacaagaatatttcattccaaataaagaattcagtctttaattatgcaactgaataaaatctaaagcctacagaaaacaacttcagaattcacacaaagtggaaaaaggcttaagtgaagacctggttggcttggttatgccacgacttccaaaggaaagtataggactaaaaccctcacagataactggatgtggcaaacattaacggagtaatgaatgggttcttcaagctttgcagctgtaagcagatcattgtcaagaagactctaggacttttcttctgattcactgttgataacatcacttatgcaaatgtatacaataagtggagtttaaaatattttcagtgagttgtatatttttacacatcagtgaggtatgtatagtaaaactgggggaaaaagttccaaatacaagcctgaagaattgctgcagcctcagaataaagctaagcagcattctttaaggttgtgccacccatgtgtgggaggaggttgacatctttatggaaacatcatccactgtagtcatttgttcatactttcagaatcttaacagaaattgttggatgaacatgcttctgctttgtagattttgccttagtgtcatgcccatacattgagtttacacagctggtccttcataggattccaaagttcaagggagtttttagagttagttgagaaacttgatgatctttcactgctgggaaaaactgactccttcttgcagcagattctttggctttacacacaagtctgaatgtccttattttaaagttttcctcaaaggtgcaacattcatggaatagcttgccaggaagatgtgaaacttttctacagacctttgaaatggatgagaaacattgtatgtagggatgtttagcaatcagtcttttaatagacagcccacattgtttcagcttatttcatgaagtgtctgaggcagaagctgatgataattttgggagcagtattcgtgtgtgatttaaaagactgcaggaatactgcaaaaatagaatccatttattttcaccacttaaggcagcttcatgtgatttcctcgtatcatagaaaatagagaaggaacatggatagcattagcactaataatacacacttgaagttctcagaatactgatgattgaaaactcaaacaactgctctgttgaagtcttcttttgatgagatgcctatgttagctgacgacattcactttaagggcttcttcactggattcttccctctcctgtttataatgcagcacagtgtttttatttttccctgtctgagaagcacagattatctgttaaatgctgacttctttcccctgctgtgtgtcttcatgtaacagtttctcacccacggataataaatttgctacatgctctgatgacggcactgttagaatctgggactttcttcgttgccatgaggaaagaattctccgagggcatggtgctgatgtgaaatgtgtagactggcatccaaccaaagggttagttgtttcaggaagtaaagatagtcaacagccaatcaagttctgggatcccaagactgggcagagtcttgcaacacttcatgcccataaaaacacagtaatggaagtgaaattaaacctcaatggcaattggctactcacagcatcacgtgatcatctctgtaaactttttgatatcagaaacctaaaagaagagcttcaagtcttccgaggtcataagaaagaagccacagctgtggcctggcatcctgttcatgaaggactttttgccagtggagggtctgatggttctttgttattctggcatgttggggtagagaaggaagtgggtgggatggagatggctcacgaagggatgatctggagtctggcttggcatcctcttgggcatattctctgctcaggctcaaatgaccatactagcaaattctggactcgaaaccgaccaggtgataaaatgcgagatcgatataatctaaaccttttacctggaatgtctgaagatggagtagaatatgatgacctcgaacctaatagcctggcagtaattccaggaatgggaataccagaacaactaaaattagctatggaacaagaacagatggggaaagatgaatcaaatgaaattgaaatgacaattccaggtttagattggggaatggaggaagtgatgcaaaaggatcagaaaaaagtacctcagaagaaagttccttatgcaaaacccattcctgctcagttccagcaggcttggatgcaaaataaagttccaattcctgctccaaatgaggtgctgaatgacagaaaagaagacattaaattggaagagaagaaaaaaacacaagcagaaattgagcaagaaatggctacattacaatatactaacccacaacttctggagcaacttaaaattgaaagacttgcacagaaacaagttgagcaaattcagcctcctccctcatctggcacccctctcctcggaccccagccttttccaggacaaggtccaatgtctcagattcctcaaggttttcaacagccccatccatctcagcagatgccaatgaacatggctcaaatggggcctccaggtccacagggacagtttaggcctcctggaccccagggacaaatgggaccacaaggtcctccactgcatcagggaggtggggggccacaaggattcatgggaccacaggggccccagggcccgccccaggggttgccacggcctcaggacatgcatgggccccaaggaatgcagaggcatcctggacctcatggccctttgggacctcaagggccacctggaccacaaggtagttctggtcctcaaggtcatatgggtcctcagggtccacctggcccacagggtcacataggcccccaaggcccgcctggccctcagggtcacttgggcccacaggggcctccgggtactcaaggtatgcagggaccacctggtcccagaggaatgcaagggcctcctcatcctcatgggatccaaggcggaccagggtctcaagggatccaaggtcctgtgtctcagggacctctgatgggattgaatccaagaggaatgcaggggcctccaggcccccgggagaaccagggtcctgctccccaagggatgattatgggccacccgcctcaagagatgagaggacctcaccctccaggtggactactgggacacggccctcaggaaatgagaggtcctcaggagatccgaggcatgcaggggcctccaccccaaggatcaatgctgggacctccccaggaattgcgagggcctccaggctcacaaagtcagcaggggccgccccagggctctttaggacctccaccccagggtggcatgcaaggaccccccggacctcagggacagcagaacccagcaagagggccacatccatctcaagggccaataccattccagcaacagaaaacgcctctgctaggtgatgggccccgggcccccttcaaccaggaaggacagagcacaggccccccacccctgataccaggcctagggcagcagggagcacaaggtcgcattccccctctgaaccccggacaaggacctggccccaacaaaggtgactcccgcggccctccaaaccatcacatgggcccgatgtcagagaggcggcatgagcagagcggcgggcctgagcatgggcccgagagggggcctttccggggtggccaggactgcaggggtccccctgataggcgtggccctcacccagacttccccgatgacttcagcagaccagatgacttccaccctgacaagcgctttggccaccggttacgtgaatttgaggggcgaggaggacctttaccgcaagaagagaagtggaggcgagggggccctgggcctccgtttccccctgatcacagggaattcagcgagggggatggccggggtgcagcccgaggccctccgggggcatgggaaggccgcaggcccggagatgaacgtttcccccgggatcccgaggacccacgttttcgagggcgcagagaagaaagtttcagaagaggagccccgccgaggcatgagggccgtgctccccccagaggaagggatggttttcctggtcctgaagactttggtccagaggagaattttgatgcttctgaggaagcggcccgaggacgagatctcagaggtcgaggtcggggtaccccacgaggaggaaggaagggtttacttcccactcctgacgagttccctcgctttgaaggagggcggaagccagattcctgggatggaaacagagagcctgggccaggtcatgaacattttcgtgatactccccgccctgatcatccccctcacgacggtcattccccagccagcagagaacgctcctcttctctccaaggcatggacatggcatccctacctccccgaaagcgcccctggcatgatggcccaggcacttctgagcacagagagatggaggccccaggaggcccttctgaagaccgaggaggcaaaggccgagggggcccaggacctgctcagagagtgcccaaatctgggcgttccagctccttagacggagagcaccacgatggataccacagagatgaaccttttgggggccctccaggcagtggcaccccttctcgagggggccggagtggcagtaactggggtagagggagtaacatgaactctggcccgccgaggcgaggagcttcacggggtggtggaaggggtcggtagaagctggaactgagtaccctgaggcctctctggacagtatgtaagaacttcttgtggactcaccaagagaaacaaaaggaagcctgcaccattgtagccctgaactcttttctgggcacctgaatcccaggaaccctcaatgaggtcttcaagatgaagagactgctgccagctaccagcctggctggccctgtcctgtccaccctcattgccccaactcccatgttgttttgtgaagataaaagctgggatctttttcttttttttaagtctcacaagacatggggcatctccacaaatttaagttcctgtccatttggaaatttgtttctatgtgtacagtttgtcagagaaaaacaaagtttttgtatgaatacagaatgtgatttacgcaagaattgacagaaaactagttgtgaagtgcttgccttaaggaaacctttggtttccatcgcatcccatctgccaaggaatgcacggttgttgctgatgttcatgagcatattaaccactaggttatctaaattaatctcagctgtgaactttgtgtttttcaacacattctgtcacaccatttttgtgacagaaaaatacttgaaaattattctaatgtagtttgtagtaggttcaaatttttattcagacatgctctgacagatggaaaattgtactctgaagagaaaatgcaatcttctggatgtccaacgagggagcttccccttggaagcatctcctaagaatcacagtttaggtttgaatcgccttgttatgatgaggagaggaacttgatgttagtcagaaataaagtcacatgccctttagataacttgaaatcacacatggagttgataaggaatggaccaaaataggtcctcaaacaattttgcaacacttaattaagttttcctctcttcctcttccatactatgtggaaataccagtgttacggcagggcgtacttctaactcacagtaagccagatagatcttgtccatggcaaattccttgtttaaaataaacataccatttagcccagtttggattggaagccaaaaattcagtttgttatataccccatgatactttctatactgacctttattttggttttacatggaagcttttattaaaaggactgtcctatggccaccttaacatttcattacattggcagcttcagttttggcatcagtcaaatttatttggcaaatttagtggtgctggaagtttctttttttcttttccttttttgacagagtcttgctctgtcacccagccaggagtgcagtggtgcaatcacggctcacttcagctttgaccctgcctcagcctccctagtagctaggactacaggcatatgccaccatgcccagctaattttttgtgtgtgtgttttttgtagagatggagtttcaccactttgtctatgctggtttcaaactcctgggctcaagcggtccacctgctgtggcctcccaaagtgctgggattgcagatctgagccacagtacctggccgctggtgctggaagtttcaatggttgcttagaaaaggcatactgatatagtttaacaggatatgaaaatttaactggttctctatgaatgtaaaaaacagcaaaagctaattgatttctgtggagtgagaaaatgtcagccatatacactgcttttcagtgttagaatcgtcgacgcagactatt

SEQ ID NO: 373054 - DNA, 2819 bp, Homo sapiens
ggtcaagactggctgagttcagatcaccagcacttactctgtgtccttgaataaatgatgtcagcaatctgggcctcagtgttctcatcagtggaactgctgataataccagcttcatatggtggctgtgaaaatgaaatgaatgaaatgaagtaatacttgtatatacctaaaagcctaaaagaagcttaaagtaactccacactctggtgtgtttccttctggtctgtttttgcctctgatagtattaataggattatataatgtatcctttcaaaaatatatagttttattttgttttcctcccaattaacattgtatcatgctttctcatatcatatgcttctttgaaacatgaacttagagtggcaaggtgttctctgagatggacattctgctgttttctctttacagtttcagaagaggagccccgccgaggcatgagggccgtgctccccccagaggaagggatggttttcctggtcctgaagactttggtccagaggagaattttgatgcttctgaggaagcggcccgaggacgagatctcagaggtcgaggtcggggtaccccacgaggaggaaggaagggtttacttcccactcctgacgagttccctcgctttgaaggagggcggaagccagattcctgggatggaaacagagagcctgggccaggtcatgaacattttcgtgatactccccgccctgatcatccccctcacgacggtcattccccagccagcagagaacgctcctcttctctccaaggcatggacatggcatccctacctccccgaaagcgcccctggcatgatggcccaggcacttctgagcacagagagatggaggccccaggaggcccttctgaagaccgaggaggcaaaggccgagggggcccaggacctgctcagagagtgcccaaatctgggcgttccagctccttagacggagagcaccacgatggataccacagagatgaaccttttgggggccctccaggcagtggcaccccttctcgagggggccggagtggcagtaactggggtagagggagtaacatgaactctggcccgccgaggcgaggagcttcacggggtggtggaaggggtcggtagaagctggaactgagtaccctgaggcctctctggacagtatgtaagaacttcttgtggactcaccaagagaaacaaaaggaagcctgcaccattgtagccctgaactcttttctgggcacctgaatcccaggaaccctcaatgaggtcttcaagatgaagagactgctgccagctaccagcctggctggccctgtcctgtccaccctcattgccccaactcccatgttgttttgtgaagataaaagctgggatctttttcttttttttaagtctcacaagacatggggcatctccacaaatttaagttcctgtccatttggaaatttgtttctatgtgtacagtttgtcagagaaaaacaaagtttttgtatgaatacagaatgtgatttacgcaagaattgacagaaaactagttgtgaagtgcttgccttaaggaaacctttggtttccatcgcatcccatctgccaaggaatgcacggttgttgctgatgttcatgagcatattaaccactaggttatctaaattaatctcagctgtgaactttgtgtttttcaacacattctgtcacaccatttttgtgacagaaaaatacttgaaaattattctaatgtagtttgtagtaggttcaaatttttattcagacatgctctgacagatggaaaattgtactctgaagagaaaatgcaatcttctggatgtccaacgagggagcttccccttggaagcatctcctaagaatcacagtttaggtttgaatcgccttgttatgatgaggagaggaacttgatgttagtcagaaataaagtcacatgccctttagataacttgaaatcacacatggagttgataaggaatggaccaaaataggtcctcaaacaattttgcaacacttaattaagttttcctctcttcctcttccatactatgtggaaataccagtgttacggcagggcgtacttctaactcacagtaagccagatagatcttgtccatggcaaattccttgtttaaaataaacataccatttagcccagtttggattggaagccaaaaattcagtttgttatataccccatgatactttctatactgacctttattttggttttacatggaagcttttattaaaaggactgtcctatggccaccttaacatttcattacattggcagcttcagttttggcatcagtcaaatttatttggcaaatttagtggtgctggaagtttctttttttcttttccttttttgacagagtcttgctctgtcacccagccaggagtgcagtggtgcaatcacggctcacttcagctttgaccctgcctcagcctccctagtagctaggactacaggcatatgccaccatgcccagctaattttttgtgtgtgtgttttttgtagagatggagtttcaccactttgtctatgctggtttcaaactcctgggctcaagcggtccacctgctgtggcctcccaaagtgctgggattgcagatctgagccacagtacctggccgctggtgctggaagtttcaatggttgcttagaaaaggcatactgatatagtttaacaggatatgaaaatttaactggttctctatgaatgtaaaaaacagcaaaagctaattgatttctgtggagtgagaaaatgtcagccatatacactgcttttcagtgttagaatcgtcgacgcagactatt

SEQ ID NO: 373055 - DNA, 1325 bp, Homo sapiens
tcccgccagtgcgtgatgacccggagagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccaggtttatacacaatataccattttctgtagtccctattgtcatggttaaattattctctaagtgtattctgggtgcagagatgcatgggctctgtcagtttctgggaaactttctgcaccctataaacacaatatttttctttgttttcacacattcaccattttgctggcacctttctgaagtagtgttgtcccggtatcagcctttgcaatatgttagagatgtactgtctgccgcattttgcactggttttctcttttcatttatgattaataatgtgtatacgttattcctttttattatctactgtgtaagacaagaatatttcattccaaataaagaattcagtctttaattatgaaaaaaaaaaaaaaaaaaaaaaaaaaaaaaaaccccatttttttttttggggcgccgggggggggcggggtgttgggcccaacggggggtcccaggggcccgggggaatgtgggaaggggggtggggccccg

SEQ ID NO: 373056 - DNA, 2549 bp, Homo sapiens
catactagtctgaagcaggttaagctgtgcctcggtgatagaacctgaaagccagtgttttgtggggtttttgggtttttgtgcttttcttttgttttttcaagaaatactttattttactaattatgaaaaggaagccaaaagtgccacatgtcacgggacagtcccagtgaacgcttgtcctagttggagcactttttattaacattagcagtgtgtacttccaaagttaagtcagtatattcaaaccttccctcaatataccctggtggctgggagcaggcagatacacttcccatggcctgggacatggcccagtgtggcccggtctccctgaaggtgctccttgctcatctcttggcttcctgtcgtctgtcacacagccctgggggcatggatctggctgatgctgaggcccatggccatgagccaggaagggggaggcagggtcaggaaagggtagaggcacacctctcagtacgctgaataccactgccagtctccctggcacccaccagaactggtccattgtcatcagagagtaaagtttgtactgggagttactgacaaacagttgctaatacaaaaagtcccatgtgaaattttctttgtttcaggccgagggggcccaggacctgctcagagagtgcccaaatctgggcgttccagctccttagacggagagcaccacgatggataccacagagatgaaccttttgggggccctccaggcagtggcaccccttctcgagggggccggagtggcagtaactggggtagagggagtaacatgaactctggcccgccgaggcgaggagcttcacggggtggtggaaggggtcggtagaagctggaactgagtaccctgaggcctctctggacagtatgtaagaacttcttgtggactcaccaagagaaacaaaaggaagcctgcaccattgtagccctgaactcttttctgggcacctgaatcccaggaaccctcaatgaggtcttcaagatgaagagactgctgccagctaccagcctggctggccctgtcctgtccaccctcattgccccaactcccatgttgttttgtgaagataaaagctgggatctttttcttttttttaagtctcacaagacatggggcatctccacaaatttaagttcctgtccatttggaaatttgtttctatgtgtacagtttgtcagagaaaaacaaagtttttgtatgaatacagaatgtgatttacgcaagaattgacagaaaactagttgtgaagtgcttgccttaaggaaacctttggtttccatcgcatcccatctgccaaggaatgcacggttgttgctgatgttcatgagcatattaaccactaggttatctaaattaatctcagctgtgaactttgtgtttttcaacacattctgtcacaccatttttgtgacagaaaaatacttgaaaattattctaatgtagtttgtagtaggttcaaatttttattcagacatgctctgacagatggaaaattgtactctgaagagaaaatgcaatcttctggatgtccaacgagggagcttccccttggaagcatctcctaagaatcacagtttaggtttgaatcgccttgttatgatgaggagaggaacttgatgttagtcagaaataaagtcacatgccctttagataacttgaaatcacacatggagttgataaggaatggaccaaaataggtcctcaaacaattttgcaacacttaattaagttttcctctcttcctcttccatactatgtggaaataccagtgttacggcagggcgtacttctaactcacagtaagccagatagatcttgtccatggcaaattccttgtttaaaataaacataccatttagcccagtttggattggaagccaaaaattcagtttgttatataccccatgatactttctatactgacctttattttggttttacatggaagcttttattaaaaggactgtcctatggccaccttaacatttcattacattggcagcttcagttttggcatcagtcaaatttatttggcaaatttagtggtgctggaagtttctttttttcttttccttttttgacagagtcttgctctgtcacccagccaggagtgcagtggtgcaatcacggctcacttcagctttgaccctgcctcagcctccctagtagctaggactacaggcatatgccaccatgcccagctaattttttgtgtgtgtgttttttgtagagatggagtttcaccactttgtctatgctggtttcaaactcctgggctcaagcggtccacctgctgtggcctcccaaagtgctgggattgcagatctgagccacagtacctggccgctggtgctggaagtttcaatggttgcttagaaaaggcatactgatatagtttaacaggatatgaaaatttaactggttctctatgaatgtaaaaaacagcaaaagctaattgatttctgtggagtgagaaaatgtcagccatatacactgcttttcagtgttagaatcgtcgacgcagactatt

SEQ ID NO: 373057 - DNA, 531 bp, Homo sapiens
cagtaatggaagtgaaattaaacctcaatggcaattggctactcacagcatcacgtgatcatctctgtaaactttttgatatcagaaacctaaaagaagagcttcaagtcttccgaggtcataagaaagaagccacaggtcagtggctgtgatatgcttctcattgaccactgttacctgtaacattctcagatcctgataattgtgtcttttcccatgtttttgttctgcagctgtggcctggcatcctgttcatgaaggactttttgccagtggagggtctgatggttctttgttattctggcatgttgggtatgtaagatttatgtgaaaaagtagtgtattttgtgaagagagcacgtgaatgtgtgcagacatgatagttttgtagcttttctaagtgttcatatatcctatatcagagactgcttgcagttttcagttctgtaaatccagcttggaatagaaaatgtacctctgtttgtggatatggaagtcattaaggaggaataaaatagattttctagtttc

SEQ ID NO: 373058 - DNA, 4620 bp, Homo sapiens
tcccgccagtgcgtgatgacccggagagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccagtttctcacccacggataataaatttgctacatgctctgatgacggcactgttagaatctgggactttcttcgttgccatgaggaaagaattctccgagggcatggtgctgatgtgaaatgtgtagactggcatccaaccaaagggttagttgtttcaggaagtaaagatagtcaacagccaatcaagttctgggatcccaagactgggcagagtcttgcaacacttcatgcccataaaaacacagtaatggaagtgaaattaaacctcaatggcaattggctactcacagcatcacgtgatcatctctgtaaactttttgatatcagaaacctaaaagaagagcttcaagtcttccgaggtcataagaaagaagccacagctgtggcctggcatcctgttcatgaaggactttttgccagtggagggtctgatggttctttgttattctggcatgttggggtagagaaggaagtgggtgggatggagatggctcacgaagggatgatctggagtctggcttggcatcctcttgggcatattctctgctcaggctcaaatgaccatactagcaaattctggactcgaaaccgaccaggtgataaaatgcgagatcgatataatctaaaccttttacctggaatgtctgaagatggagtagaatatgatgacctcgaacctaatagcctggcagtaattccaggaatgggaataccagaacaactaaaattagctatggaacaagaacagatggggaaagatgaatcaaatgaaattgaaatgacaattccaggtttagattggggaatggaggaagtgatgcaaaaggatcagaaaaaagtacctcagaagaaagttccttatgcaaaacccattcctgctcagttccagcaggcttggatgcaaaataaagttccaattcctgctccaaatgaggtgctgaatgacagaaaagaagacattaaattggaagagaagaaaaaaacacaagcagaaattgagcaagaaatggctacattacaatatactaacccacaacttctggagcaacttaaaattgaaagacttgcacagaaacaagttgagcaaattcagcctcctccctcatctggcacccctctcctcggaccccagccttttccaggacaaggtccaatgtctcagattcctcaaggttttcaacagccccatccatctcagcagatgccaatgaacatggctcaaatggggcctccaggtccacagggacagtttaggcctcctggaccccagggacaaatgggaccacaaggtcctccactgcatcagggaggtggggggccacaaggattcatgggaccacaggggccccagggcccgccccaggggttgccacggcctcaggacatgcatgggccccaaggaatgcagaggcatcctggacctcatggccctttgggacctcaagggccacctggaccacaaggtagttctggtcctcaaggtcatatgggtcctcagggtccacctggcccacagggtcacataggcccccaaggcccgcctggccctcagggtcacttgggcccacaggggcctccgggtactcaaggtatgcagggaccacctggtcccagaggaatgcaagggcctcctcatcctcatgggatccaaggcggaccagggtctcaagggatccaaggtcctgtgtctcagggacctctgatgggattgaatccaagaggaatgcaggggcctccaggcccccgggagaaccagggtcctgctccccaagggatgattatgggccacccgcctcaagagatgagaggacctcaccctccaggtggactactgggacacggccctcaggaaatgagaggtcctcaggagatccgaggcatgcaggggcctccaccccaaggatcaatgctgggacctccccaggaattgcgagggcctccaggctcacaaagtcagcaggggccgccccagggctctttaggacctccaccccagggtggcatgcaaggaccccccggacctcagggacagcagaacccagcaagagggccacatccatctcaagggccaataccattccagcaacagaaaacgcctctgctaggtgatgggccccgggcccccttcaaccaggaaggacagagcacaggccccccacccctgataccaggcctagggcagcagggagcacaaggtcgcattccccctctgaaccccggacaaggacctggccccaacaaaggtgactcccgcggccctccaaaccatcacatgggcccgatgtcagagaggcggcatgagcagagcggcgggcctgagcatgggcccgagagggggcctttccggggtggccaggactgcaggggtccccctgataggcgtggccctcacccagacttccccgatgacttcagcagaccagatgacttccaccctgacaagcgctttggccaccggttacgtgaatttgaggggcgaggaggacctttaccgcaagaagagaagtggaggcgagggggccctgggcctccgtttccccctgatcacagggaattcagcgagggggatggccggggtgcagcccgaggccctccgggggcatgggaaggccgcaggcccggagatgaacgtttcccccgggatcccgaggacccacgttttcgagggcgcagagaagaaagtttcagaagaggagccccgccgaggcatgagggccgtgctccccccagaggaagggatggttttcctggtcctgaagactttggtccagaggagaattttgatgcttctgaggaagcggcccgaggacgagatctcagaggtcgaggtcggggtaccccacgaggaggaaggaagggtttacttcccactcctgacgagttccctcgctttgaaggagggcggaagccagattcctgggatggaaacagagagcctgggccaggtcatgaacattttcgtgatactccccgccctgatcatccccctcacgacggtcattccccagccagcagagaacgctcctcttctctccaaggcatggacatggcatccctacctccccgaaagcgcccctggcatgatggcccaggcacttctgagcacagagagatggaggccccaggaggcccttctgaagaccgaggaggcaaaggccgagggggcccaggacctgctcagagagtgcccaaatctgggcgttccagctccttagacggagagcaccacgatggataccacagagatgaaccttttgggggccctccaggcagtggcaccccttctcgagggggccggagtggcagtaactggggtagagggagtaacatgaactctggcccgccgaggcgaggagcttcacggggtggtggaaggggtcggtagaagctggaactgagtaccctgaggcctctctggacagtatgtaagaacttcttgtggactcaccaagagaaacaaaaggaagcctgcaccattgtagccctgaactcttttctgggcacctgaatcccaggaaccctcaatgaggtcttcaagatgaagagactgctgccagctaccagcctggctggccctgtcctgtccaccctcattgccccaactcccatgttgttttgtgaagataaaagctgggatctttttcttttttttaagtctcacaagacatggggcatctccacaaatttaagttcctgtccatttggaaatttgtttctatgtgtacagtttgtcagagaaaaacaaagtttttgtatgaatacagaatgtgatttacgcaagaattga

SEQ ID NO: 373059 - DNA, 1193 bp, Homo sapiens
tcccgccagtgcgtgatgacccggagagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccaggtttatacacaatataccattttctgtagtccctattgtcatggttaaattattctctaagtgtattctgggtgcagagatgcatgggctctgtcagtttctgggaaactttctgcaccctataaacacaatatttttctttgttttcacacattcaccattttgctggcacctttctgaagtagtgttgtcccggtatcagcctttgcaatatgttagagatgtactgtctgccgcattttgcactggttttctcttttcatttatgattaataatgtgtatacgttattcctttttattatctactgtgtaagacaagaatatttcattccaaataaagaattcagtctttaattatg

SEQ ID NO: 373060 - DNA, 735 bp, Homo sapiens
tcccgccagtgcgtgatgacccggagagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgcctgccgagtgcctgccattgcaggcacgcgccgccacgcctgactggttttggtggagacggggtttcgctgtgttggccgggccggtctccagcccctaaccgcgagtgatcccgccaacctcagcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctc

SEQ ID NO: 373061 - DNA, 7149 bp, Homo sapiens
tcccgccagtgcgtgatgacccggagagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccaggtttatacacaatataccattttctgtagtccctattgtcatggttaaattattctctaagtgtattctgggtgcagagatgcatgggctctgtcagtttctgggaaactttctgcaccctataaacacaatatttttctttgttttcacacattcaccattttgctggcacctttctgaagtagtgttgtcccggtatcagcctttgcaatatgttagagatgtactgtctgccgcattttgcactggttttctcttttcatttatgattaataatgtgtatacgttattcctttttattatctactgtgtaagacaagaatatttcattccaaataaagaattcagtctttaattatgcaactgaataaaatctaaagcctacagaaaacaacttcagaattcacacaaagtggaaaaaggcttaagtgaagacctggttggcttggttatgccacgacttccaaaggaaagtataggactaaaaccctcacagataactggatgtggcaaacattaacggagtaatgaatgggttcttcaagctttgcagctgtaagcagatcattgtcaagaagactctaggacttttcttctgattcactgttgataacatcacttatgcaaatgtatacaataagtggagtttaaaatattttcagtgagttgtatatttttacacatcagtgaggtatgtatagtaaaactgggggaaaaagttccaaatacaagcctgaagaattgctgcagcctcagaataaagctaagcagcattctttaaggttgtgccacccatgtgtgggaggaggttgacatctttatggaaacatcatccactgtagtcatttgttcatactttcagaatcttaacagaaattgttggatgaacatgcttctgctttgtagattttgccttagtgtcatgcccatacattgagtttacacagctggtccttcataggattccaaagttcaagggagtttttagagttagttgagaaacttgatgatctttcactgctgggaaaaactgactccttcttgcagcagattctttggctttacacacaagtctgaatgtccttattttaaagttttcctcaaaggtgcaacattcatggaatagcttgccaggaagatgtgaaacttttctacagacctttgaaatggatgagaaacattgtatgtagggatgtttagcaatcagtcttttaatagacagcccacattgtttcagcttatttcatgaagtgtctgaggcagaagctgatgataattttgggagcagtattcgtgtgtgatttaaaagactgcaggaatactgcaaaaatagaatccatttattttcaccacttaaggcagcttcatgtgatttcctcgtatcatagaaaatagagaaggaacatggatagcattagcactaataatacacacttgaagttctcagaatactgatgattgaaaactcaaacaactgctctgttgaagtcttcttttgatgagatgcctatgttagctgacgacattcactttaagggcttcttcactggattcttccctctcctgtttataatgcagcacagtgtttttatttttccctgtctgagaagcacagattatctgttaaatgctgacttctttcccctgctgtgtgtcttcatgtaacagtttctcacccacggataataaatttgctacatgctctgatgacggcactgttagaatctgggactttcttcgttgccatgaggaaagaattctccgagggcatggtgctgatgtgaaatgtgtagactggcatccaaccaaagggttagttgtttcaggaagtaaagatagtcaacagccaatcaagttctgggatcccaagactgggcagagtcttgcaacacttcatgcccataaaaacacagtaatggaagtgaaattaaacctcaatggcaattggctactcacagcatcacgtgatcatctctgtaaactttttgatatcagaaacctaaaagaagagcttcaagtcttccgaggtcataagaaagaagccacagctgtggcctggcatcctgttcatgaaggactttttgccagtggagggtctgatggttctttgttattctggcatgttggggtagagaaggaagtgggtgggatggagatggctcacgaagggatgatctggagtctggcttggcatcctcttgggcatattctctgctcaggctcaaatgaccatactagcaaattctggactcgaaaccgaccaggtgataaaatgcgagatcgatataatctaaaccttttacctggaatgtctgaagatggagtagaatatgatgacctcgaacctaatagcctggcagtaattccaggaatgggaataccagaacaactaaaattagctatggaacaagaacagatggggaaagatgaatcaaatgaaattgaaatgacaattccaggtttagattggggaatggaggaagtgatgcaaaaggatcagaaaaaagtacctcagaagaaagttccttatgcaaaacccattcctgctcagttccagcaggcttggatgcaaaataaagttccaattcctgctccaaatgaggtgctgaatgacagaaaagaagacattaaattggaagagaagaaaaaaacacaagcagaaattgagcaagaaatggctacattacaatatactaacccacaacttctggagcaacttaaaattgaaagacttgcacagaaacaagttgagcaaattcagcctcctccctcatctggcacccctctcctcggaccccagccttttccaggacaaggtccaatgtctcagattcctcaaggttttcaacagccccatccatctcagcagatgccaatgaacatggctcaaatggggcctccaggtccacagggacagtttaggcctcctggaccccagggacaaatgggaccacaaggtcctccactgcatcagggaggtggggggccacaaggattcatgggaccacaggggccccagggcccgccccaggggttgccacggcctcaggacatgcatgggccccaaggaatgcagaggcatcctggacctcatggccctttgggacctcaagggccacctggaccacaaggtagttctggtcctcaaggtcatatgggtcctcagggtccacctggcccacagggtcacataggcccccaaggcccgcctggccctcagggtcacttgggcccacaggggcctccgggtactcaaggtatgcagggaccacctggtcccagaggaatgcaagggcctcctcatcctcatgggatccaaggcggaccagggtctcaagggatccaaggtcctgtgtctcagggacctctgatgggattgaatccaagaggaatgcaggggcctccaggcccccgggagaaccagggtcctgctccccaagggatgattatgggccacccgcctcaagagatgagaggacctcaccctccaggtggactactgggacacggccctcaggaaatgagaggtcctcaggagatccgaggcatgcaggggcctccaccccaaggatcaatgctgggacctccccaggaattgcgagggcctccaggctcacaaagtcagcaggggccgccccagggctctttaggacctccaccccagggtggcatgcaaggaccccccggacctcagggacagcagaacccagcaagagggccacatccatctcaagggccaataccattccagcaacagaaaacgcctctgctaggtgatgggccccgggcccccttcaaccaggaaggacagagcacaggccccccacccctgataccaggcctagggcagcagggagcacaaggtcgcattccccctctgaaccccggacaaggacctggccccaacaaagtttcagaagaggagccccgccgaggcatgagggccgtgctccccccagaggaagggatggttttcctggtcctgaagactttggtccagaggagaattttgatgcttctgaggaagcggcccgaggacgagatctcagaggtcgaggtcggggtaccccacgaggaggaaggaagggtttacttcccactcctgacgagttccctcgctttgaaggagggcggaagccagattcctgggatggaaacagagagcctgggccaggtcatgaacattttcgtgatactccccgccctgatcatccccctcacgacggtcattccccagccagcagagaacgctcctcttctctccaaggcatggacatggcatccctacctccccgaaagcgcccctggcatgatggcccaggcacttctgagcacagagagatggaggccccaggaggcccttctgaagaccgaggaggcaaaggccgagggggcccaggacctgctcagagagtgcccaaatctgggcgttccagctccttagacggagagcaccacgatggataccacagagatgaaccttttgggggccctccaggcagtggcaccccttctcgagggggccggagtggcagtaactggggtagagggagtaacatgaactctggcccgccgaggcgaggagcttcacggggtggtggaaggggtcggtagaagctggaactgagtaccctgaggcctctctggacagtatgtaagaacttcttgtggactcaccaagagaaacaaaaggaagcctgcaccattgtagccctgaactcttttctgggcacctgaatcccaggaaccctcaatgaggtcttcaagatgaagagactgctgccagctaccagcctggctggccctgtcctgtccaccctcattgccccaactcccatgttgttttgtgaagataaaagctgggatctttttcttttttttaagtctcacaagacatggggcatctccacaaatttaagttcctgtccatttggaaatttgtttctatgtgtacagtttgtcagagaaaaacaaagtttttgtatgaatacagaatgtgatttacgcaagaattgacagaaaactagttgtgaagtgcttgccttaaggaaacctttggtttccatcgcatcccatctgccaaggaatgcacggttgttgctgatgttcatgagcatattaaccactaggttatctaaattaatctcagctgtgaactttgtgtttttcaacacattctgtcacaccatttttgtgacagaaaaatacttgaaaattattctaatgtagtttgtagtaggttcaaatttttattcagacatgctctgacagatggaaaattgtactctgaagagaaaatgcaatcttctggatgtccaacgagggagcttccccttggaagcatctcctaagaatcacagtttaggtttgaatcgccttgttatgatgaggagaggaacttgatgttagtcagaaataaagtcacatgccctttagataacttgaaatcacacatggagttgataaggaatggaccaaaataggtcctcaaacaattttgcaacacttaattaagttttcctctcttcctcttccatactatgtggaaataccagtgttacggcagggcgtacttctaactcacagtaagccagatagatcttgtccatggcaaattccttgtttaaaataaacataccatttagcccagtttggattggaagccaaaaattcagtttgttatataccccatgatactttctatactgacctttattttggttttacatggaagcttttattaaaaggactgtcctatggccaccttaacatttcattacattggcagcttcagttttggcatcagtcaaatttatttggcaaatttagtggtgctggaagtttctttttttcttttccttttttgacagagtcttgctctgtcacccagccaggagtgcagtggtgcaatcacggctcacttcagctttgaccctgcctcagcctccctagtagctaggactacaggcatatgccaccatgcccagctaattttttgtgtgtgtgttttttgtagagatggagtttcaccactttgtctatgctggtttcaaactcctgggctcaagcggtccacctgctgtggcctcccaaagtgctgggattgcagatctgagccacagtacctggccgctggtgctggaagtttcaatggttgcttagaaaaggcatactgatatagtttaacaggatatgaaaatttaactggttctctatgaatgtaaaaaacagcaaaagctaattgatttctgtggagtgagaaaatgtcagccatatacactgcttttcagtgttagaatcgtcgacgcagactatt

SEQ ID NO: 373062 - DNA, 7548 bp, Homo sapiens
tcccgccagtgcgtgatgacccggagagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccaggtttatacacaatataccattttctgtagtccctattgtcatggttaaattattctctaagtgtattctgggtgcagagatgcatgggctctgtcagtttctgggaaactttctgcaccctataaacacaatatttttctttgttttcacacattcaccattttgctggcacctttctgaagtagtgttgtcccggtatcagcctttgcaatatgttagagatgtactgtctgccgcattttgcactggttttctcttttcatttatgattaataatgtgtatacgttattcctttttattatctactgtgtaagacaagaatatttcattccaaataaagaattcagtctttaattatgcaactgaataaaatctaaagcctacagaaaacaacttcagaattcacacaaagtggaaaaaggcttaagtgaagacctggttggcttggttatgccacgacttccaaaggaaagtataggactaaaaccctcacagataactggatgtggcaaacattaacggagtaatgaatgggttcttcaagctttgcagctgtaagcagatcattgtcaagaagactctaggacttttcttctgattcactgttgataacatcacttatgcaaatgtatacaataagtggagtttaaaatattttcagtgagttgtatatttttacacatcagtgaggtatgtatagtaaaactgggggaaaaagttccaaatacaagcctgaagaattgctgcagcctcagaataaagctaagcagcattctttaaggttgtgccacccatgtgtgggaggaggttgacatctttatggaaacatcatccactgtagtcatttgttcatactttcagaatcttaacagaaattgttggatgaacatgcttctgctttgtagattttgccttagtgtcatgcccatacattgagtttacacagctggtccttcataggattccaaagttcaagggagtttttagagttagttgagaaacttgatgatctttcactgctgggaaaaactgactccttcttgcagcagattctttggctttacacacaagtctgaatgtccttattttaaagttttcctcaaaggtgcaacattcatggaatagcttgccaggaagatgtgaaacttttctacagacctttgaaatggatgagaaacattgtatgtagggatgtttagcaatcagtcttttaatagacagcccacattgtttcagcttatttcatgaagtgtctgaggcagaagctgatgataattttgggagcagtattcgtgtgtgatttaaaagactgcaggaatactgcaaaaatagaatccatttattttcaccacttaaggcagcttcatgtgatttcctcgtatcatagaaaatagagaaggaacatggatagcattagcactaataatacacacttgaagttctcagaatactgatgattgaaaactcaaacaactgctctgttgaagtcttcttttgatgagatgcctatgttagctgacgacattcactttaagggcttcttcactggattcttccctctcctgtttataatgcagcacagtgtttttatttttccctgtctgagaagcacagattatctgttaaatgctgacttctttcccctgctgtgtgtcttcatgtaacagtttctcacccacggataataaatttgctacatgctctgatgacggcactgttagaatctgggactttcttcgttgccatgaggaaagaattctccgagggcatggtgctgatgtgaaatgtgtagactggcatccaaccaaagggttagttgtttcaggaagtaaagatagtcaacagccaatcaagttctgggatcccaagactgggcagagtcttgcaacacttcatgcccataaaaacacagtaatggaagtgaaattaaacctcaatggcaattggctactcacagcatcacgtgatcatctctgtaaactttttgatatcagaaacctaaaagaagagcttcaagtcttccgaggtcataagaaagaagccacagctgtggcctggcatcctgttcatgaaggactttttgccagtggagggtctgatggttctttgttattctggcatgttggggtagagaaggaagtgggtgggatggagatggctcacgaagggatgatctggagtctggcttggcatcctcttgggcatattctctgctcaggctcaaatgaccatactagcaaattctggactcgaaaccgaccaggtgataaaatgcgagatcgatataatctaaaccttttacctggaatgtctgaagatggagtagaatatgatgacctcgaacctaatagcctggcagtaattccaggaatgggaataccagaacaactaaaattagctatggaacaagaacagatggggaaagatgaatcaaatgaaattgaaatgacaattccaggtttagattggggaatggaggaagtgatgcaaaaggatcagaaaaaagtacctcagaagaaagttccttatgcaaaacccattcctgctcagttccagcaggcttggatgcaaaataaagttccaattcctgctccaaatgaggtgctgaatgacagaaaagaagacattaaattggaagagaagaaaaaaacacaagcagaaattgagcaagaaatggctacattacaatatactaacccacaacttctggagcaacttaaaattgaaagacttgcacagaaacaagttgagcaaattcagcctcctccctcatctggcacccctctcctcggaccccagccttttccaggacaaggtccaatgtctcagattcctcaaggttttcaacagccccatccatctcagcagatgccaatgaacatggctcaaatggggcctccaggtccacagggacagtttaggcctcctggaccccagggacaaatgggaccacaaggtcctccactgcatcagggaggtggggggccacaaggattcatgggaccacaggggccccagggcccgccccaggggttgccacggcctcaggacatgcatgggccccaaggaatgcagaggcatcctggacctcatggccctttgggacctcaagggccacctggaccacaaggtagttctggtcctcaaggtcatatgggtcctcagggtccacctggcccacagggtcacataggcccccaaggcccgcctggccctcagggtcacttgggcccacaggggcctccgggtactcaaggtatgcagggaccacctggtcccagaggaatgcaagggcctcctcatcctcatgggatccaaggcggaccagggtctcaagggatccaaggtcctgtgtctcagggacctctgatgggattgaatccaagaggaatgcaggggcctccaggcccccgggagaaccagggtcctgctccccaagggatgattatgggccacccgcctcaagagatgagaggacctcaccctccaggtggactactgggacacggccctcaggaaatgagaggtcctcaggagatccgaggcatgcaggggcctccaccccaaggatcaatgctgggacctccccaggaattgcgagggcctccaggctcacaaagtcagcaggggccgccccagggctctttaggacctccaccccagggtggcatgcaaggaccccccggacctcagggacagcagaacccagcaagagggccacatccatctcaagggccaataccattccagcaacagaaaacgcctctgctaggtgatgggccccgggcccccttcaaccaggaaggacagagcacaggccccccacccctgataccaggcctagggcagcagggagcacaaggtcgcattccccctctgaaccccggacaaggacctggccccaacaaaggtgactcccgcggccctccaaaccatcacatgggcccgatgtcagagaggcggcatgagcagagcggcgggcctgagcatgggcccgagagggggcctttccggggtggccaggactgcaggggtccccctgataggcgtggccctcacccagacttccccgatgacttcagcagaccagatgacttccaccctgacaagcgctttggccaccggttacgtgaatttgaggggcgaggaggacctttaccgcaagaagagaagtggaggcgagggggccctgggcctccgtttccccctgatcacagggaattcagcgagggggatggccggggtgcagcccgaggccctccgggggcatgggaaggccgcaggcccggagatgaacgtttcccccgggatcccgaggacccacgttttcgagggcgcagagaagaaagtttcagaagaggagccccgccgaggcatgagggccgtgctccccccagaggaagggatggttttcctggtcctgaagactttggtccagaggagaattttgatgcttctgaggaagcggcccgaggacgagatctcagaggtcgaggtcggggtaccccacgaggaggaaggaagggtttacttcccactcctgacgagttccctcgctttgaaggagggcggaagccagattcctgggatggaaacagagagcctgggccaggtcatgaacattttcgtgatactccccgccctgatcatccccctcacgacggtcattccccagccagcagagaacgctcctcttctctccaaggcatggacatggcatccctacctccccgaaagcgcccctggcatgatggcccaggcacttctgagcacagagagatggaggccccaggaggcccttctgaagaccgaggaggcaaaggccgagggggcccaggacctgctcagagagtgcccaaatctgggcgttccagctccttagacggagagcaccacgatggataccacagagatgaaccttttgggggccctccaggcagtggcaccccttctcgagggggccggagtggcagtaactggggtagagggagtaacatgaactctggcccgccgaggcgaggagcttcacggggtggtggaaggggtcggtagaagctggaactgagtaccctgaggcctctctggacagtatgtaagaacttcttgtggactcaccaagagaaacaaaaggaagcctgcaccattgtagccctgaactcttttctgggcacctgaatcccaggaaccctcaatgaggtcttcaagatgaagagactgctgccagctaccagcctggctggccctgtcctgtccaccctcattgccccaactcccatgttgttttgtgaagataaaagctgggatctttttcttttttttaagtctcacaagacatggggcatctccacaaatttaagttcctgtccatttggaaatttgtttctatgtgtacagtttgtcagagaaaaacaaagtttttgtatgaatacagaatgtgatttacgcaagaattgacagaaaactagttgtgaagtgcttgccttaaggaaacctttggtttccatcgcatcccatctgccaaggaatgcacggttgttgctgatgttcatgagcatattaaccactaggttatctaaattaatctcagctgtgaactttgtgtttttcaacacattctgtcacaccatttttgtgacagaaaaatacttgaaaattattctaatgtagtttgtagtaggttcaaatttttattcagacatgctctgacagatggaaaattgtactctgaagagaaaatgcaatcttctggatgtccaacgagggagcttccccttggaagcatctcctaagaatcacagtttaggtttgaatcgccttgttatgatgaggagaggaacttgatgttagtcagaaataaagtcacatgccctttagataacttgaaatcacacatggagttgataaggaatggaccaaaataggtcctcaaacaattttgcaacacttaattaagttttcctctcttcctcttccatactatgtggaaataccagtgttacggcagggcgtacttctaactcacagtaagccagatagatcttgtccatggcaaattccttgtttaaaataaacataccatttagcccagtttggattggaagccaaaaattcagtttgttatataccccatgatactttctatactgacctttattttggttttacatggaagcttttattaaaaggactgtcctatggccaccttaacatttcattacattggcagcttcagttttggcatcagtcaaatttatttggcaaatttagtggtgctggaagtttctttttttcttttccttttttgacagagtcttgctctgtcacccagccaggagtgcagtggtgcaatcacggctcacttcagctttgaccctgcctcagcctccctagtagctaggactacaggcatatgccaccatgcccagctaattttttgtgtgtgtgttttttgtagagatggagtttcaccactttgtctatgctggtttcaaactcctgggctcaagcggtccacctgctgtggcctcccaaagtgctgggattgcagatctgagccacagtacctggccgctggtgctggaagtttcaatggttgcttagaaaaggcatactgatatagtttaacaggatatgaaaatttaactggttctctatgaatgtaaaaaacagcaaaagctaattgatttctgtggagtgagaaaatgtcagccatatacactgcttttcagtgttagaatcgtcgacgcagactatt

SEQ ID NO: 373063 - DNA, 4750 bp, Homo sapiens
agagtccaagtccaggctttggtagcttcattttaagagtaacagaaaatgtcttttttgagggggagggagaagctgggtaacttttgtgaacaaatcttctctctttggtgctgttgcagggtagagaaggaagtgggtgggatggagatggctcacgaagggatgatctggagtctggcttggcatcctcttgggcatattctctgctcaggctcaaatgaccatactagcaaattctggactcgaaaccgaccaggtgataaaatgcgagatcgatataatctaaaccttttacctggaatgtctgaagatggagtagaatatgatgacctcgaacctaatagcctggcagtaattccaggaatgggaataccagaacaactaaaattagctatggaacaagaacagatggggaaagatgaatcaaatgaaattgaaatgacaattccaggtttagattggggaatggaggaagtgatgcaaaaggatcagaaaaaagtacctcagaagaaagttccttatgcaaaacccattcctgctcagttccagcaggcttggatgcaaaataaagttccaattcctgctccaaatgaggtgctgaatgacagaaaagaagacattaaattggaagagaagaaaaaaacacaagcagaaattgagcaagaaatggctacattacaatatactaacccacaacttctggagcaacttaaaattgaaagacttgcacagaaacaagttgagcaaattcagcctcctccctcatctggcacccctctcctcggaccccagccttttccaggacaaggtccaatgtctcagattcctcaaggttttcaacagccccatccatctcagcagatgccaatgaacatggctcaaatggggcctccaggtccacagggacagtttaggcctcctggaccccagggacaaatgggaccacaaggtcctccactgcatcagggaggtggggggccacaaggattcatgggaccacaggggccccagggcccgccccaggggttgccacggcctcaggacatgcatgggccccaaggaatgcagaggcatcctggacctcatggccctttgggacctcaagggccacctggaccacaaggtagttctggtcctcaaggtcatatgggtcctcagggtccacctggcccacagggtcacataggcccccaaggcccgcctggccctcagggtcacttgggcccacaggggcctccgggtactcaaggtatgcagggaccacctggtcccagaggaatgcaagggcctcctcatcctcatgggatccaaggcggaccagggtctcaagggatccaaggtcctgtgtctcagggacctctgatgggattgaatccaagaggaatgcaggggcctccaggcccccgggagaaccagggtcctgctccccaagggatgattatgggccacccgcctcaagagatgagaggacctcaccctccaggtggactactgggacacggccctcaggaaatgagaggtcctcaggagatccgaggcatgcaggggcctccaccccaaggatcaatgctgggacctccccaggaattgcgagggcctccaggctcacaaagtcagcaggggccgccccagggctctttaggacctccaccccagggtggcatgcaaggaccccccggacctcagggacagcagaacccagcaagagggccacatccatctcaagggccaataccattccagcaacagaaaacgcctctgctaggtgatgggccccgggcccccttcaaccaggaaggacagagcacaggccccccacccctgataccaggcctagggcagcagggagcacaaggtcgcattccccctctgaaccccggacaaggacctggccccaacaaaggtgactcccgcggccctccaaaccatcacatgggcccgatgtcagagaggcggcatgagcagagcggcgggcctgagcatgggcccgagagggggcctttccggggtggccaggactgcaggggtccccctgataggcgtggccctcacccagacttccccgatgacttcagcagaccagatgacttccaccctgacaagcgctttggccaccggttacgtgaatttgaggggcgaggaggacctttaccgcaagaagagaagtggaggcgagggggccctgggcctccgtttccccctgatcacagggaattcagcgagggggatggccggggtgcagcccgaggccctccgggggcatgggaaggccgcaggcccggagatgaacgtttcccccgggatcccgaggacccacgttttcgagggcgcagagaagaaagtttcagaagaggagccccgccgaggcatgagggccgtgctccccccagaggaagggatggttttcctggtcctgaagactttggtccagaggagaattttgatgcttctgaggaagcggcccgaggacgagatctcagaggtcgaggtcggggtaccccacgaggaggaaggaagggtttacttcccactcctgacgagttccctcgctttgaaggagggcggaagccagattcctgggatggaaacagagagcctgggccaggtcatgaacattttcgtgatactccccgccctgatcatccccctcacgacggtcattccccagccagcagagaacgctcctcttctctccaaggcatggacatggcatccctacctccccgaaagcgcccctggcatgatggcccaggcacttctgagcacagagagatggaggccccaggaggcccttctgaagaccgaggaggcaaaggccgagggggcccaggacctgctcagagagtgcccaaatctgggcgttccagctccttagacggagagcaccacgatggataccacagagatgaaccttttgggggccctccaggcagtggcaccccttctcgagggggccggagtggcagtaactggggtagagggagtaacatgaactctggcccgccgaggcgaggagcttcacggggtggtggaaggggtcggtagaagctggaactgagtaccctgaggcctctctggacagtatgtaagaacttcttgtggactcaccaagagaaacaaaaggaagcctgcaccattgtagccctgaactcttttctgggcacctgaatcccaggaaccctcaatgaggtcttcaagatgaagagactgctgccagctaccagcctggctggccctgtcctgtccaccctcattgccccaactcccatgttgttttgtgaagataaaagctgggatctttttcttttttttaagtctcacaagacatggggcatctccacaaatttaagttcctgtccatttggaaatttgtttctatgtgtacagtttgtcagagaaaaacaaagtttttgtatgaatacagaatgtgatttacgcaagaattgacagaaaactagttgtgaagtgcttgccttaaggaaacctttggtttccatcgcatcccatctgccaaggaatgcacggttgttgctgatgttcatgagcatattaaccactaggttatctaaattaatctcagctgtgaactttgtgtttttcaacacattctgtcacaccatttttgtgacagaaaaatacttgaaaattattctaatgtagtttgtagtaggttcaaatttttattcagacatgctctgacagatggaaaattgtactctgaagagaaaatgcaatcttctggatgtccaacgagggagcttccccttggaagcatctcctaagaatcacagtttaggtttgaatcgccttgttatgatgaggagaggaacttgatgttagtcagaaataaagtcacatgccctttagataacttgaaatcacacatggagttgataaggaatggaccaaaataggtcctcaaacaattttgcaacacttaattaagttttcctctcttcctcttccatactatgtggaaataccagtgttacggcagggcgtacttctaactcacagtaagccagatagatcttgtccatggcaaattccttgtttaaaataaacataccatttagcccagtttggattggaagccaaaaattcagtttgttatataccccatgatactttctatactgacctttattttggttttacatggaagcttttattaaaaggactgtcctatggccaccttaacatttcattacattggcagcttcagttttggcatcagtcaaatttatttggcaaatttagtggtgctggaagtttctttttttcttttccttttttgacagagtcttgctctgtcacccagccaggagtgcagtggtgcaatcacggctcacttcagctttgaccctgcctcagcctccctagtagctaggactacaggcatatgccaccatgcccagctaattttttgtgtgtgtgttttttgtagagatggagtttcaccactttgtctatgctggtttcaaactcctgggctcaagcggtccacctgctgtggcctcccaaagtgctgggattgcagatctgagccacagtacctggccgctggtgctggaagtttcaatggttgcttagaaaaggcatactgatatagtttaacaggatatgaaaatttaactggttctctatgaatgtaaaaaacagcaaaagctaattgatttctgtggagtgagaaaatgtcagccatatacactgcttttcagtgttagaatcgtcgacgcagactatt

SEQ ID NO: 373064 - DNA, 1175 bp, Homo sapiens
tcccgccagtgcgtgatgacccggagagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccagtttctcacccacggataataaatttgctacatgctctgatgacggcactgttagaatctgggactttcttcgttgccatgaggaaagaattctccgaggcatggctgatgtgaactgtgttcaacggctcccaccaagggttattgttcagaagtaagaatcacagccatcagttcgggtccccatggccgagtttggaacttttgccataaacacgatggaggagataccccccgggtcggttacactcaggatcctggatggttgaaccagaaacgttccggaaaaacgtgtgcgttcaagagccgggagaatatcatgacgcaacaaacacgctcatac

SEQ ID NO: 373065 - DNA, 5704 bp, Homo sapiens
atttagttgaaaccatgccagagggaaggaacaagagtaaatattcaggtgtatgtgtatgtagaggggaatgaaatgtgcatgtatatataatcatatttttttgctctgcttctgtaggcttttttaaaaaagagaataaggttttcagtctgctgtcagattcttaggatgtttttaagggtattattcattacattacacagtaaactttttatgaagactcttgagggtaatttatttctgatcaaggactcaagagtaattatgatttttcttactggtttgtttttatcttaacgacaatgtgtgtataactacattttatttaagaattgcttgttagagtgtttaaaaccaaattcgttgcccacccatatacagcaaggatgtaggtgtccagggtagccacagtcctcactcctcattgtactcctgtcttcattttccctctatcttttcatctacttcaaatttatcatcattgtagtctgcatcacttataaacctccagaaatgttttgtttttttttttttggaaaaaaggtaaatgtcttatcataagccaccaaaaacctattttaccagcttcttttttcttccctttccagattgagatgctaccagatgggctgtttcagtgcaaaaagctgcagtgtttacttttggggaaaaatagcttgatgaatttgtcccctcatgtgggtgagctgtcaaaccttactcatctggagctcattggtaattacctggaaacacttcctcctgaactagaaggatgtcagtccctaaaacggaactgtctgattgttgaggagaacttgctcaatactcttcctctccctgtaacagaacgtttacagacgtgcttagacaaatgttgacttaaagaaaagagacccgtgtttcaaaatcatttttaaaagtatgctcggccgggcgtggtggctcatgcctataatcccagcactttgggaggccaagatgggcggattgcttgaggtcaggagttcgagaccagtctggccaacctggtgaaaccccatctctgctaaaactacaaaaaaattagccaggcgtggtggcgtgcgcctgtaatcccagctacttgggaggctgacgcaggggaattgcttgaaccagggaggtggaggttgcagtgagccgagattgtgccactgtacaccagcctgggtgacagagcaagactcttatctcaaaaaaaaaaaaaaaatgctccagggctttaaatgagaagtaaaattttctaagttaataaagatgaagaatgggtgactattatgatgaaccataactaaatgtcttattaaagcaactgagtgtctagccctaaattaaccaggtaaaaactgttaacactaacctgaagttttgtgaataactgttctttaacttattgagatgttgcaagaaatgcacatccagggtggactgggagctatgaaatgactaaattcctccttgcagtgtttaccttcaagattgtataggtattctctcctcttcttcccccagtccccattacttatttgcacacttgttttaactgacttcctgttttgatatttatcaccaagaccataaactcatcaatatgaattttcttgatgtatactcacgactgtctttgatttatgttcctaaatttttttagatagggtatgttgtgcttggcagaattcttttttggcttaatttttacttcctttcccagcttgcttgagtcttccttaacctggttttctcttaacaccaatgatgaaccctgagaaaatgcctgcatttggcctttgcctagaacaggagctgagtatttaagatgtattatcctcgggtcatcctgaaaattaatgtattccctaaaatttcttcttgtctatcatcaaggcctttttttatttgttaagaatttttatattaaatgtaaaacatataaatattttctattgtataatcttggattcaacatctgtgaggatcatttttgtaagatacatagaatttgtgcatttctttatgaacttactgttagtgttcttggtttcggctgtttatgactcatgtttatgtacattctgctccaaaatgtttttgtactctgcaactaattacttttggataacaaaagccttgtgtttaatgccctaaagtatttgggggtttccttgtgagagggtggccgaatcatctacctctctcttccatagttgctgtgcaatcgtacgggtaaaattcttaattacttacaaaaactgtgatagaggggagaggtacagatttggtttttaaattgattttaaaatactttatagaaatttagtaagagttaaagcaaaagactttttttccctccatctatgtaatctctagctatgattataatgtaaaacagcctctattcagtgtctaaaatgagttctcaaaacccacaaagaaatagatccatttaactgaaattcatctcatgcctttatctaactcttctggaaaatacattttgctcctttttataaagagctttgtgcttggccttttattatgcatatttttaatgaataaaatcaactgactcatttttgggaaatgtacatctttaatatgtttttccctaagggtctaggcattatgatgccacctcttcattttggatataactatgaagaaatctattaactgcacctacacaaaactggaaaacactataggtaaacagtactgtgtatatggaattgtggtgcgtggtatgtgttttctcttgctttgttccagaaagatgaaagtgagtctttaaagcatagcaaatagagcttcccctcacctgccacacactcctgcactaaagttcaaagaaaagaattattcaaatcaaatgaaatttgaataatattagctatcaggaatataggacaccaaacacactgcctcacacattattgtttattctgaacggaaaggaacagtgtaaaaataaactacttaccaaaacttgcctttagtcagaacattcagctctcagggaagcaggtataactgatgaaacttctaggacttcagaaaacagattctaattatatccatgttttttgttgttattttcattttttaaagtgtgagttgatgtttattttagtgtttcacaatagaattatcatgtatactgattccagtgtggcatgtgattaagttttggacatgaatatgccaaaagtgcttaaatgtttttggccacataactagctagaatttcaaaacaaaattcagatttgctaccattcacctgacgaacttctccatggctcgtcactggtttggttcaactgcagaagtcattggctaaattttccttatcacctacgtaaatttctagaagaatttactagcaggattaataatgaatattataaactgctttccacacactagggtataattattggtgcaatctatgttgttcttgatgccatggttttacatcttttaatttaaaccttatacaccagtgtttaggtcgcttttgagacaaggtagccctgatgcaaggaaaaatgaggctactacttcacataaaaaatagggtgttaataccacctttactgtactgttggagcagatctttattttacaagtgttcatattcacataagagaattttaaatgaagaaaattaagtttgttaaattataattatgagactttcgttggcatttgatttcaagaatacatatgcattttccaaaaaataaatgtggaggttattcagaacaaaattcatagcttacggtagtaatggcatggattaattttatttgcatgcacacacagacacacatacttcatatatgcaaattatagcattagttttgatatatctagtggtttttttttcaaaattgcaggaggttgtagattaaattaagtatgatagcacgttttttaattcattaatcatgaagtgctctgttccctaagttatgacatttagaagaaatcacatgctcaaccttaatctgagaacctaagtgtttttgagcattccagtaaaggagtagtgttcttttcctaacttacatcagggtacatctgtgtggcacacagatactatcttttcattcttcactcccagtcttaatttctttcccctgtatgtcactgtattttatgtcacttcacattgtgttaaacagggtaaatagagatcctcagtatctcagtgctgtggcatagctccaataggtgtgctgtggtgcactgcagtgatgtatttgcataacattgtttgatagtgaaaaattttttttcggttcaagtgttttgtgattaaaattttatgtttaattaaaatattgcataatattgatgggttcaaaaaccattaaaataatcaaacaattattctgtgcccttaacattattttcttgtgttttcaataaaattttcttttcatctttccatcttcacattctcttagcatcatcctatgcacataaggtatgttgttttccttctccactcacctaccgcactaaatttgatcagcaattgtacagtaacagaatatatttgtgccagaagatttgcaatgatatttgagcatgtatttatttaggaggaagccagtgcctgtaattatgtctcattgagtagttttactttgcccatcctgcagtatttagagctgatctgtacccaaagcaggacaatgtaactgtagatctgctttgttttcagtaactgtacattgcatcagaatctgtttatttctatctggaaacagacagaatggtgggggagggaaggagttattttgcatcctagtttgtattatgaagtcatcatatatatatttgaaatagtataagctaattactgttgcagaatgccctcgatataattatttcttttcagctggatgtgaaaagctgaagcagtgaaaacctgcagtcttatttcactggtttccttctgtttcttgtccatcacttctgtatccacagggagctatctactacatacctttggtaacaggctacattctcttcagattttttatatgaataatttcatcagcactaaagcattaacatagaataatgagccaaagtactgagtcgagatggctttcagttgagtttaatttcatatttaacttttgcatttaacttgtataatacactactgctgagaaaaacaattatgaatgccttctgcatgttgtacattatctctaacagagatggtgcaattttaagaatacaaaggggtatagagttagaatggatgtgttcgtgcatatatatgttgtatttaaatattaatgtttacaagaagattttttttaaattcttcaaatacttcacttagtgaaataatgggccaatctggaatagagacattttatttggttagtgcaagagtgaaagctagcatttgttaaccttcacatatttatctgtgtacaattgtttttgcttctggtaatgaattattagaaaatggaagattttgttcaatgtttttggccctcaggtttactgtgtaaatctgcatttttggtggtaaatccctttgccacagattcagtagcttttggtaaacttcactgtttttaaagtaccttttgtgtaaaataaagatccaatttttataacaaatggcaaataaaaacagtaaatgctggaagaa

SEQ ID NO: 373066 - DNA, 3225 bp, Homo sapiens
tggtctgacctcttcctacagcctgtggtggatgctgaggagttccctgaagcaatattcctttgaggcgttaagagaaaaaagcaactacagtgacatccctgatgtcaagaatgactttgccttcatccttcatctggctgatcagtatgatcctctttattccaaacgcttctccatattcctatcagaggtcagtgagaacaaactgaaacagatcaacctcaataatgaatggacagttgagaaactgaaaagtaagcttgtgaaaaatgcccaggacaagatagaactgcatctttttatgctcaacggtcttccagacaatgtctttgagttaactgaaatggaagtgctaagcctggagcttatcccagaggtgaagctgccctctgcagtctcacagctggtcaacctcaaggagcttcgtgtgtaccattcatctctggtcgtagaccatcctgcactggcctttctagaggagaatttaaaaatcctccgcctgaaatttactgaaatgggaaaaatcccacgctgggtatttcacctcaagaatctcaaggaactttatctttcgggctgtgttctccctgaacagttgagtactatgcagttggagggctttcaggacttaaaaaatctaaggaccctgtacttgaagagcagcctctcccggatcccacaagttgttacagacctcctgccttcattgcagaaactgtcccttgataatgagggaagcaaactggttgtgttgaacaacttgaaaaagatggtcaatctgaaaagcctagaactgatcagctgtgacctggaacgcatcccacattccattttcagcctgaataatttgcatgagttagacctaagggaaaataaccttaaaactgtggaagagatcattagctttcagcatcttcagaatctttcctgcttaaagttgtggcacaataacattgcttatattcctgcacagattggggcattatctaacctagagcagctctctttggaccataataatattgagaatctgcccttgcagcttttcctatgcactaaactacattatttggatctaagctataaccacttgaccttcattccagaagaaatccagtatctgagtaatttgcagtactttgctgtgaccaacaacaatattgagatgctaccagatgggctgtttcagtgcaaaaagctgcagtgtttacttttggggaaaaatagcttgatgaatttgtcccctcatgtgggtgagctgtcaaaccttactcatctggagctcattggtaattacctggaaacacttcctcctgaactagaaggatgtcagtccctaaaacggaactgtctgattgttgaggagaacttgctcaatactcttcctctccctgtaacagaacgtttacagacgtgcttagacaaatgttgacttaaagaaaagagacccgtgtttcaaaatcatttttaaaagtatgctcggccgggcgtggtggctcatgcctataatcccagcactttgggaggccaagatgggcggattgcttgaggtcaggagttcgagaccagtctggccaacctggtgaaaccccatctctgctaaaactacaaaaaaattagccaggcgtggtggcgtgcgcctgtaatcccagctacttgggaggctgacgcaggggaattgcttgaaccagggaggtggaggttgcagtgagccgagattgtgccactgtacaccagcctgggtgacagagcaagactcttatctcaaaaaaaaaaaaaaaatgctccagggctttaaatgagaagtaaaattttctaagttaataaagatgaagaatgggtgactattatgatgaaccataactaaatgtcttattaaagcaactgagtgtctagccctaaattaaccaggtaaaaactgttaacactaacctgaagttttgtgaataactgttctttaacttattgagatgttgcaagaaatgcacatccagggtggactgggagctatgaaatgactaaattcctccttgcagtgtttaccttcaagattgtataggtattctctcctcttcttcccccagtccccattacttatttgcacacttgttttaactgacttcctgttttgatatttatcaccaagaccataaactcatcaatatgaattttcttgatgtatactcacgactgtctttgatttatgttcctaaatttttttagatagggtatgttgtgcttggcagaattcttttttggcttaatttttacttcctttcccagcttgcttgagtcttccttaacctggttttctcttaacaccaatgatgaaccctgagaaaatgcctgcatttggcctttgcctagaacaggagctgagtatttaagatgtattatcctcgggtcatcctgaaaattaatgtattccctaaaatttcttcttgtctatcatcaaggcctttttttatttgttaagaatttttatattaaatgtaaaacatataaatattttctattgtataatcttggattcaacatctgtgaggatcatttttgtaagatacatagaatttgtgcatttctttatgaacttactgttagtgttcttggtttcggctgtttatgactcatgtttatgtacattctgctccaaaatgtttttgtactctgcaactaattacttttggataacaaaagccttgtgtttaatgccctaaagtatttgggggtttccttgtgagagggtggccgaatcatctacctctctcttccatagttgctgtgcaatcgtacgggtaaaattcttaattacttacaaaaactgtgatagaggggagaggtacagatttggtttttaaattgattttaaaatactttatagaaatttagtaagagttaaagcaaaagactttttttccctccatctatgtaatctctagctatgattataatgtaaaacagcctctattcagtgtctaaaatgagttctcaaaacccacaaagaaatagatccatttaatttttgagatggagtcccgctctgtcgcccaggctggagtgcagtggcgcgatctcggctcactgcaagctccgcctcctgggttcacgccattctcctgcctcagcctcccgagtagctgggactacaggcgcccgccaacactcctggctaatttttttgtatttttagtagagacggggtttcactgtgttagccaggat

SEQ ID NO: 373067 - DNA, 3217 bp, Homo sapiens
  misc_feature (2930)..(2930): n is a, c, g, or t
tggtctgacctcttcctacagcctgtggtggatgctgaggagttccctgaagcaatattcctttgaggcgttaagagaaaaaagcaactacagtgacatccctgatgtcaagaatgactttgccttcatccttcatctggctgatcagtatgatcctctttattccaaacgcttctccatattcctatcagaggtcagtgagaacaaactgaaacagatcaacctcaataatgaatggacagttgagaaactgaaaagtaagcttgtgaaaaatgcccaggacaagatagaactgcatctttttatgctcaacggtcttccagacaatgtctttgagttaactgaaatggaagtgctaagcctggagcttatcccagaggtgaagctgccctctgcagtctcacagctggtcaacctcaaggagcttcgtgtgtaccattcatctctggtcgtagaccatcctgcactggcctttctagaggagaatttaaaaatcctccgcctgaaatttactgaaatgggaaaaatcccacgctgggtatttcacctcaagaatctcaaggaactttatctttcgggctgtgttctccctgaacagttgagtactatgcagttggagggctttcaggacttaaaaaatctaaggaccctgtacttgaagagcagcctctcccggatcccacaagttgttacagacctcctgccttcattgcagaaactgtcccttgataatgagggaagcaaactggttgtgttgaacaacttgaaaaagatggtcaatctgaaaagcctagaactgatcagctgtgacctggaacgcatcccacattccattttcagcctgaataatttgcatgagttagacctaagggaaaataaccttaaaactgtggaagagatcattagctttcagcatcttcagaatctttcctgcttaaagttgtggcacaataacattgcttatattcctgcacagattggggcattatctaacctagagcagctctctttggaccataataatattgagaatctgcccttgcagcttttcctatgcactaaactacattatttggatctaagctataaccacttgaccttcattccagaagaaatccagtatctgagtaatttgcagtactttgctgtgaccaacaacaatattgagatgctaccagatgggctgtttcagtgcaaaaagctgcagtgtttacttttggggaaaaatagcttgatgaatttgtcccctcatgtgggtgagctgtcaaaccttactcatctggagctcattggtaattacctggaaacacttcctcctgaactagaaggatgtcagtccctaaaacggaactgtctgattgttgaggagaacttgctcaatactcttcctctccctgtaacagaacgtttacagacgtgcttagacaaatgttgacttaaagaaaagagacccgtgtttcaaaatcatttttaaaagtatgctcggccgggcgtggtggctcatgcctataatcccagcactttgggaggccaagatgggcggattgcttgaggtcaggagttcgagaccagtctggccaacctggtgaaaccccatctctgctaaaactacaaaaaaattagccaggcgtggtggcgtgcgcctgtaatcccagctacttgggaggctgacgcaggggaattgcttgaaccagggaggtggaggttgcagtgagccgagattgtgccactgtacaccagcctgggtgacagagcaagactcttatctcaaaaaaaaaaaaaaaatgctccagggctttaaatgagaagtaaaattttctaagttaataaagatgaagaatgggtgactattatgatgaaccataactaaatgtcttattaaagcaactgagtgtctagccctaaattaaccaggtaaaaactgttaacactaacctgaagttttgtgaataactgttctttaacttattgagatgttgcaagaaatgcacatccagggtggactgggagctatgaaatgactaaattcctccttgcagtgtttaccttcaagattgtataggtattctctcctcttcttcccccagtccccattacttatttgcacacttgttttaactgacttcctgttttgatatttatcaccaagaccataaactcatcaatatgaattttcttgatgtatactcacgactgtctttgatttatgttcctaaatttttttagatagggtatgttgtgcttggcagaattcttttttggcttaatttttacttcctttcccagcttgcttgagtcttccttaacctggttttctcttaacaccaatgatgaaccctgagaaaatgcctgcatttggcctttgcctagaacaggagctgagtatttaagatgtattatcctcgggtcatcctgaaaattaatgtattccctaaaatttcttcttgtctatcatcaaggcctttttttatttgttaagaatttttatattaaatgtaaaacatataaatattttctattgtataatcttggattcaacatctgtgaggatcatttttgtaagatacatagaatttgtgcatttctttatgaacttactgttagtgttcttggtttcggctgtttatgactcatgtttatgtacattctgctccaaaatgtttttgtactctgcaactaattacttttggataacaaaagccttgtgtttaatgccctaaagtatttgggggtttccttgtgagagggtggccgaatcatctacctcttttttttctctttttttccatagttgctgtgcaactcgtacgggtcacacaaattctcccttttttaacaaccttttttcaaaccccttttttttttttaaaaacccccccaaaaaaaataaccccaaaactcaacacaacgtgaacacgatgtgttttttngtggggggggggaccttttgctggcggcgcaccacaacacaacacgcgtctttctttccacaccaccccgggcggtcgcccacaaacacaccaccggcggtggcgtaacgccgcgtcggtattatagctgccatgcatctgtcgccgaccaccaccaacaacatgcgcggcggcgtagcccaccaccaacaacacctcgggcggcgcacccagaggcggcacgccatattatttttcttacaccaccacccacccgcccccaccacccgccaacaacagtggcagtc

SEQ ID NO: 373068 - DNA, 6255 bp, Homo sapiens
tggtctgacctcttcctacagcctgtggtggatgctgaggagttccctgaagcaatattcctttgaggcgttaagagaaaaaagcaactacagtgacatccctgatgtcaagaatgactttgccttcatccttcatctggctgatcagtatgatcctctttattccaaacgcttctccatattcctatcagaggtcagtgagaacaaactgaaacagatcaacctcaataatgaatggacagttgagaaactgaaaagtaagcttgtgaaaaatgcccaggacaagatagaactgcatctttttatgctcaacggtcttccagacaatgtctttgagttaactgaaatggaagtgctaagcctggagcttatcccagaggtgaagctgccctctgcagtctcacagctggtcaacctcaaggagcttcgtgtgtaccattcatctctggtcgtagaccatcctgcactggcctttctagaggagaatttaaaaatcctccgcctgaaatttactgaaatgggaaaaatcccacgctgggtatttcacctcaagaatctcaaggaactttatctttcgggctgtgttctccctgaacagttgagtactatgcagttggagggctttcaggacttaaaaaatctaaggaccctgtacttgaagagcagcctctcccggatcccacaagttgttacagacctcctgccttcattgcagaaactgtcccttgataatgagggaagcaaactggttgtgttgaacaacttgaaaaagatggtcaatctgaaaagcctagaactgatcagctgtgacctggaacgcatcccacattccattttcagcctgaataatttgcatgagttagacctaagggaaaataaccttaaaactgtggaagagatcattagctttcagcatcttcagaatctttcctgcttaaagttgtggcacaataacattgcttatattcctgcacagattggggcattatctaacctagagcagctctctttggaccataataatattgagaatctgcccttgcagcttttcctatgcactaaactacattatttggatctaagctataaccacttgaccttcattccagaagaaatccagtatctgagtaatttgcagtactttgctgtgaccaacaacaatattgagatgctaccagatgggctgtttcagtgcaaaaagctgcagtgtttacttttggggaaaaatagcttgatgaatttgtcccctcatgtgggtgagctgtcaaaccttactcatctggagctcattggtaattacctggaaacacttcctcctgaactagaaggatgtcagtccctaaaacggaactgtctgattgttgaggagaacttgctcaatactcttcctctccctgtaacagaacgtttacagacgtgcttagacaaatgttgacttaaagaaaagagacccgtgtttcaaaatcatttttaaaagtatgctcggccgggcgtggtggctcatgcctataatcccagcactttgggaggccaagatgggcggattgcttgaggtcaggagttcgagaccagtctggccaacctggtgaaaccccatctctgctaaaactacaaaaaaattagccaggcgtggtggcgtgcgcctgtaatcccagctacttgggaggctgacgcaggggaattgcttgaaccagggaggtggaggttgcagtgagccgagattgtgccactgtacaccagcctgggtgacagagcaagactcttatctcaaaaaaaaaaaaaaaatgctccagggctttaaatgagaagtaaaattttctaagttaataaagatgaagaatgggtgactattatgatgaaccataactaaatgtcttattaaagcaactgagtgtctagccctaaattaaccaggtaaaaactgttaacactaacctgaagttttgtgaataactgttctttaacttattgagatgttgcaagaaatgcacatccagggtggactgggagctatgaaatgactaaattcctccttgcagtgtttaccttcaagattgtataggtattctctcctcttcttcccccagtccccattacttatttgcacacttgttttaactgacttcctgttttgatatttatcaccaagaccataaactcatcaatatgaattttcttgatgtatactcacgactgtctttgatttatgttcctaaatttttttagatagggtatgttgtgcttggcagaattcttttttggcttaatttttacttcctttcccagcttgcttgagtcttccttaacctggttttctcttaacaccaatgatgaaccctgagaaaatgcctgcatttggcctttgcctagaacaggagctgagtatttaagatgtattatcctcgggtcatcctgaaaattaatgtattccctaaaatttcttcttgtctatcatcaaggcctttttttatttgttaagaatttttatattaaatgtaaaacatataaatattttctattgtataatcttggattcaacatctgtgaggatcatttttgtaagatacatagaatttgtgcatttctttatgaacttactgttagtgttcttggtttcggctgtttatgactcatgtttatgtacattctgctccaaaatgtttttgtactctgcaactaattacttttggataacaaaagccttgtgtttaatgccctaaagtatttgggggtttccttgtgagagggtggccgaatcatctacctctctcttccatagttgctgtgcaatcgtacgggtaaaattcttaattacttacaaaaactgtgatagaggggagaggtacagatttggtttttaaattgattttaaaatactttatagaaatttagtaagagttaaagcaaaagactttttttccctccatctatgtaatctctagctatgattataatgtaaaacagcctctattcagtgtctaaaatgagttctcaaaacccacaaagaaatagatccatttaactgaaattcatctcatgcctttatctaactcttctggaaaatacattttgctcctttttataaagagctttgtgcttggccttttattatgcatatttttaatgaataaaatcaactgactcatttttgggaaatgtacatctttaatatgtttttccctaagggtctaggcattatgatgccacctcttcattttggatataactatgaagaaatctattaactgcacctacacaaaactggaaaacactataggtaaacagtactgtgtatatggaattgtggtgcgtggtatgtgttttctcttgctttgttccagaaagatgaaagtgagtctttaaagcatagcaaatagagcttcccctcacctgccacacactcctgcactaaagttcaaagaaaagaattattcaaatcaaatgaaatttgaataatattagctatcaggaatataggacaccaaacacactgcctcacacattattgtttattctgaacggaaaggaacagtgtaaaaataaactacttaccaaaacttgcctttagtcagaacattcagctctcagggaagcaggtataactgatgaaacttctaggacttcagaaaacagattctaattatatccatgttttttgttgttattttcattttttaaagtgtgagttgatgtttattttagtgtttcacaatagaattatcatgtatactgattccagtgtggcatgtgattaagttttggacatgaatatgccaaaagtgcttaaatgtttttggccacataactagctagaatttcaaaacaaaattcagatttgctaccattcacctgacgaacttctccatggctcgtcactggtttggttcaactgcagaagtcattggctaaattttccttatcacctacgtaaatttctagaagaatttactagcaggattaataatgaatattataaactgctttccacacactagggtataattattggtgcaatctatgttgttcttgatgccatggttttacatcttttaatttaaaccttatacaccagtgtttaggtcgcttttgagacaaggtagccctgatgcaaggaaaaatgaggctactacttcacataaaaaatagggtgttaataccacctttactgtactgttggagcagatctttattttacaagtgttcatattcacataagagaattttaaatgaagaaaattaagtttgttaaattataattatgagactttcgttggcatttgatttcaagaatacatatgcattttccaaaaaataaatgtggaggttattcagaacaaaattcatagcttacggtagtaatggcatggattaattttatttgcatgcacacacagacacacatacttcatatatgcaaattatagcattagttttgatatatctagtggtttttttttcaaaattgcaggaggttgtagattaaattaagtatgatagcacgttttttaattcattaatcatgaagtgctctgttccctaagttatgacatttagaagaaatcacatgctcaaccttaatctgagaacctaagtgtttttgagcattccagtaaaggagtagtgttcttttcctaacttacatcagggtacatctgtgtggcacacagatactatcttttcattcttcactcccagtcttaatttctttcccctgtatgtcactgtattttatgtcacttcacattgtgttaaacagggtaaatagagatcctcagtatctcagtgctgtggcatagctccaataggtgtgctgtggtgcactgcagtgatgtatttgcataacattgtttgatagtgaaaaattttttttcggttcaagtgttttgtgattaaaattttatgtttaattaaaatattgcataatattgatgggttcaaaaaccattaaaataatcaaacaattattctgtgcccttaacattattttcttgtgttttcaataaaattttcttttcatctttccatcttcacattctcttagcatcatcctatgcacataaggtatgttgttttccttctccactcacctaccgcactaaatttgatcagcaattgtacagtaacagaatatatttgtgccagaagatttgcaatgatatttgagcatgtatttatttaggaggaagccagtgcctgtaattatgtctcattgagtagttttactttgcccatcctgcagtatttagagctgatctgtacccaaagcaggacaatgtaactgtagatctgctttgttttcagtaactgtacattgcatcagaatctgtttatttctatctggaaacagacagaatggtgggggagggaaggagttattttgcatcctagtttgtattatgaagtcatcatatatatatttgaaatagtataagctaattactgttgcagaatgccctcgatataattatttcttttcagctggatgtgaaaagctgaagcagtgaaaacctgcagtcttatttcactggtttccttctgtttcttgtccatcacttctgtatccacagggagctatctactacatacctttggtaacaggctacattctcttcagattttttatatgaataatttcatcagcactaaagcattaacatagaataatgagccaaagtactgagtcgagatggctttcagttgagtttaatttcatatttaacttttgcatttaacttgtataatacactactgctgagaaaaacaattatgaatgccttctgcatgttgtacattatctctaacagagatggtgcaattttaagaatacaaaggggtatagagttagaatggatgtgttcgtgcatatatatgttgtatttaaatattaatgtttacaagaagattttttttaaattcttcaaatacttcacttagtgaaataatgggccaatctggaatagagacattttatttggttagtgcaagagtgaaagctagcatttgttaaccttcacatatttatctgtgtacaattgtttttgcttctggtaatgaattattagaaaatggaagattttgttcaatgtttttggccctcaggtttactgtgtaaatctgcatttttggtggtaaatccctttgccacagattcagtagcttttggtaaacttcactgtttttaaagtaccttttgtgtaaaataaagatccaatttttataacaaatggcaaataaaaacagtaaatgctggaagaa

SEQ ID NO: 373069 - DNA, 818 bp, Homo sapiens
gctgacgtggagcgtccgggttagcgggtgcggcgagctgcgggattggggagcaacgggccgggccgggccttcgggcccgaggcggcggcggcggtataaagccggcgactgggagcatgtaatgtcggaatgcggaggccgcggcggcggcagcagcagcagcgaggacgccgaggacgagggagggggcggcggcggccccgcgggctcagactgcctcagctcgagcccgaccctggccacagcgtcctcggcgggccggctccgtcgcgggctgcgtggcgccttcctcatggcgcgccagcggccggagctgctctgcggggccgtggcgctcggctgcgcgctgctcctcgccctcaagttcacctgcagtcgagcaaaagatgtgataataccagcaaagccacctgtcagctttttctccttgaggtctccagtccttgacctcttccaggggcagctggattatgcagagtacgttcgacgggattcagaggtggtactgctcttcttctatgccccttggtgtggacagtccatcgctgccagggcagaaattgagcaagcagcaagtcggctttcagatcaggtgttgtttgtggcaattaactgttggtggaaccaggggaaatgcagaaaacagaaacacttcttttattttcctgtaatatatctgtatcatcggaggtaagaactttttaaatagcgtctctcattccagtttagtttgccagtttataaatgaattttgcattttttctatattaaagtattagatattcactatagaaaattcagataatacagataag

SEQ ID NO: 373070 - DNA, 2228 bp, Homo sapiens
gctgacgtggagcgtccgggttagcgggtgcggcgagctgcgggattggggagcaacgggccgggccgggccttcgggcccgaggcggcggcggcggtataaagccggcgactgggagcatgtaatgtcggaatgcggaggccgcggcggcggcagcagcagcagcgaggacgccgaggacgagggagggggcggcggcggccccgcgggctcagactgcctcagctcgagcccgaccctggccacagcgtcctcggcgggccggctccgtcgcgggctgcgtggcgccttcctcatggcgcgccagcggccggagctgctctgcggggccgtggcgctcggctgcgcgctgctcctcgccctcaagttcacctgcagtcgagcaaaagatgtgataataccagcaaagccacctgtcagctttttctccttgaggtctccagtccttgacctcttccaggggcagctggattatgcagagtacgttcgacgggattcagaggtggtactgctcttcttctatgccccttggtgtggacagtccatcgctgccagggcagaaattgagcaagcagcaagtcggctttcagatcaggtgttgtttgtggcaattaactgttggtggaaccaggggaaatgcagaaaacagaaacacttcttttattttcctgtaatatatctgtatcatcggagttttggaccaatcgaatacaaaggccccatgagtgctgtttacattgagaagtttgtccgccgggtgatgaaaccacttctctacatcccatctcaatcagaattactagattttctctcaaactacgagcctggagtactcgggtactttgagttcagtggctcaccccagcctcctggttatttgaccttcttcacctcagcattacattcattaaagaaagattacctaggaacagtacgatttggggttatcacaaataaacatcttgcgaaactggtatccttagtacactctggaagtgtgtatttacatagacatttcaacacatcacttgtcttccccagggaggtcctgaactacacagctgagaacatctgtaagtgggccttagaaaaccaggagacgctctttcggtggctgcggccacacggaggcaagagtctcctgctgaataacgagctgaagaaaggaccagcgctgtttctgttcataccttttaatcccctggccgaaagtcatcctttaatagacgagatcaccgaagtggccttggagtacaacaactgtcatggggaccaggtggtggagcgtctccttcagcacctgcggcgggtggatgctccagtgctggagtccctggccctggaagtgccggcacagctgccagacccgccaacgatcacagcgtccccctgctgcaacactgtggtgctgccccagtggcactccttctccaggacccacaacgtctgtgaactctgtgtcaaccagacctccgggggcatgaagccgagctcggtcagcgtgccacagtgcagcttttttgaaatggcagcagctctggattctttctacctcaaggagcagaccttttatcatgtggcatcagacagcatagaatgcagcaattttttaacttcctatagccccttcagctactacactgcatgttgcaggaccataagcaggggtgtgtcaggcttcatcgactctgaacaaggtgtctttgaagcccctactgttgcattttcttcccttgagaagaaatgtgaggttgatgccccaagctccgttcctcacattgaggagaacaggtatctctttccagaagtggacatgactagcacaaacttcacaggcctgagctgcagaaccaacaagactctcaacatctaccttttggattcaaatttgttttggttatatgcagagagactgggtgctccgagctccactcaggtgaaagaatttgcggcaattgttgacgtgaaagaagaatctcattacatcttggatccaaagcaagcactgatgaagctcaccctaggtactgcaggcagtttatttccccaagcattgtacattttgcttgacttcatatgggtaaattttattgatggctctcattacatttagttgtggggtgatgtcaccttcgtagctcattttaagtctttagaccaccatcagtcataattttcaaagaagctaattttgtctattaaatggaacagaaacttcctcactctga

SEQ ID NO: 373071 - DNA, 673 bp, Homo sapiens
ctgcccggggcaggcctctagagcagttgcggttagctcccacagtgattgagcacaggctgggtgagttagtacagatgtcattttctgtattagaaaattaatgtcaaatctgctaagaaaataggctgtttttggtctctatccagatttacaacataaagagggtataattttccatcttcagaggggcttgatgtattttgctcaatgatttcctttcttttcccagagctattcagggattaaaatacttggctagatcctgtcaggtgaggagtgaatgactcctcaggtgtcagtgcggcattttctgcaagttcatttttactttcaggacatcacattgccactcagtggaaagcgtccacgtagtagaatgttgtatgtcttggaagtatcagcgcccagctcacacctggtagtacattcatcgagaagggactagcccaatgtggggtgtaaaaaatgcaccaggttcttgaagttatctgagaaggttctttcaagttggtgtttcttgggctgatcatctgccatttctgttctttccctttaccaggattgacgtgtctcagaatgaccttccttgggaatttatggtcgatcgtcttcctactgtcttgttttttccctgcaacaggtaatgccaaatttttgtcactggtgggca

SEQ ID NO: 373072 - DNA, 3124 bp, Homo sapiens
gctgacgtggagcgtccgggttagcgggtgcggcgagctgcgggattggggagcaacgggccgggccgggccttcgggcccgaggcggcggcggcggtataaagccggcgactgggagcatgtaatgtcggaatgcggaggccgcggcggcggcagcagcagcagcgaggacgccgaggacgagggagggggcggcggcggccccgcgggctcagactgcctcagctcgagcccgaccctggccacagcgtcctcggcgggccggctccgtcgcgggctgcgtggcgccttcctcatggcgcgccagcggccggagctgctctgcggggccgtggcgctcggctgcgcgctgctcctcgccctcaagttcacctgcagtcgagcaaaagatgtgataataccagcaaagccacctgtcagctttttctccttgaggtctccagtccttgacctcttccaggggcagctggattatgcagagtacgttcgacgggattcagaggtggtactgctcttcttctatgccccttggtgtggacagtccatcgctgccagggcagaaattgagcaagcagcaagtcggctttcagatcaggtgttgtttgtggcaattaactgttggtggaaccaggggaaatgcagaaaacagaaacacttcttttattttcctgtaatatatctgtatcatcggagttttggaccaatcgaatacaaaggccccatgagtgctgtttacattgagaagtttgtccgccgggtgatgaaaccacttctctacatcccatctcaatcagaattactagattttctctcaaactacgagcctggagtactcgggtactttgagttcagtggctcaccccagcctcctggttatttgaccttcttcacctcagcattacattcattaaagaaagattacctaggaacagtacgatttggggttatcacaaataaacatcttgcgaaactggtatccttagtacactctggaagtgtgtatttacatagacatttcaacacatcacttgtcttccccagggaggtcctgaactacacagctgagaacatctgtaagtgggccttagaaaaccaggagacgctctttcggtggctgcggccacacggaggcaagagtctcctgctgaataacgagctgaagaaaggaccagcgctgtttctgttcataccttttaatcccctggccgaaagtcatcctttaatagacgagatcaccgaagtggccttggagtacaacaactgtcatggggaccaggtggtggagcgtctccttcagcacctgcggcgggtggatgctccagtgctggagtccctggccctggaagtgccggcacagctgccagacccgccaacgatcacagcgtccccctgctgcaacactgtggtgctgccccagtggcactccttctccaggacccacaacgtctgtgaactctgtgtcaaccagacctccgggggcatgaagccgagctcggtcagcgtgccacagtgcagcttttttgaaatggcagcagctctggattctttctacctcaaggagcagaccttttatcatgtggcatcagacagcatagaatgcagcaattttttaacttcctatagccccttcagctactacactgcatgttgcaggaccataagcaggggtgtgtcaggcttcatcgactctgaacaaggtgtctttgaagcccctactgttgcattttcttcccttgagaagaaatgtgaggttgatgccccaagctccgttcctcacattgaggagaacaggtatctctttccagaagtggacatgactagcacaaacttcacaggcctgagctgcagaaccaacaagactctcaacatctaccttttggattcaaatttgttttggttatatgcagagagactgggtgctccgagctccactcaggtgaaagaatttgcggcaattgttgacgtgaaagaagaatctcattacatcttggatccaaagcaagcactgatgaagctcaccctagagtcttttattcaaaacttcagcgttctctatagtcccttgaaaaggcatctcattggaagtggctctgcccagttcccgtctcagcatttaatcactgaagtgacaactgataccttttgggaagtagtccttcaaaaacaggacgttctcctgctctattacgctccgtggtgcggcttctgtccatccctcaatcacatcttcatccagctagctcggaacctgcccatggacacattcactgtggcaaggattgacgtgtctcagaatgaccttccttgggaatttatggtcgatcgtcttcctactgtcttgttttttccctgcaacagaaaggacctaagtgtgaaataccccgaagacgtccccatcacccttccaaacctgttgaggttcattttgcatcactcagaccctgcttccagcccccagaatgtggctaactctcctaccaaggagtgtcttcagagcgaggcagtcttacagcgggggcacatctcccacttggagagagagatccagaaactgagagcagaaataagcagcctccagcgagcacaagtgcaggtggagtcccagctctccagtgcccgcagagatgagcaccggctgcggcagcagcagcgggccctggaagagcagcacagcctgctccacgcacacagtgagcagctgcaggccctctatgagcagaagacacgtgagctgcaggagctggcccgcaagctgcaggagctggccgatgcctcagaaaacctccttaccgagaacacgtggctcaagatcctggtggcgaccatggagaggaaactggagggcagggatggagctgaaagcctggcggcccagagagaggtccaccccaagcagcctgagccctcagccaccccccagctccctggcagctcccctccacctgccaatgtcagcgccacactggtgtctgaaaggaataaggagaacaggacagactaactttttaaatgatatgaagaaatcagaggtgaaaattgtacattgggaatatatttatgcaaattttattgaaatttattgtaaataaagattttctcagtggtctagaaaatcagcttgaat

SEQ ID NO: 373073 - DNA, 3079 bp, Homo sapiens
gctgacgtggagcgtccgggttagcgggtgcggcgagctgcgggattggggagcaacgggccgggccgggccttcgggcccgaggcggcggcggcggtataaagccggcgactgggagcatgtaatgtcggaatgcggaggccgcggcggcggcagcagcagcagcgaggacgccgaggacgagggagggggcggcggcggccccgcgggctcagactgcctcagctcgagcccgaccctggccacagcgtcctcggcgggccggctccgtcgcgggctgcgtggcgccttcctcatggcgcgccagcggccggagctgctctgcggggccgtggcgctcggctgcgcgctgctcctcgccctcaagttcacctgcagtcgagcaaaagatgtgataataccagcaaagccacctgtcagctttttctccttgaggtctccagtccttgacctcttccaggggcagctggattatgcagagtacgttcgacgggattcagaggtggtactgctcttcttctatgccccttggtgtggacagtccatcgctgccagggcagaaattgagcaagcagcaagtcggctttcagatcaggtgttgtttgtggcaattaactgttggtggaaccaggggaaatgcagaaaacagaaacacttcttttattttcctgtaatatatctgtatcatcggagttttggaccaatcgaatacaaaggccccatgagtgctgtttacattgagaagtttgtccgccgggtgatgaaaccacttctctacatcccatctcaatcagaattactagattttctctcaaactacgagcctggagtactcgggtactttgagttcagtggctcaccccagcctcctggttatttgaccttcttcacctcagcattacattcattaaagaaagattacctaggaacagtacgatttggggttatcacaaataaacatcttgcgaaactggtatccttagtacactctggaagtgtgtatttacatagacatttcaacacatcacttgtcttccccagggaggtcctgaactacacagctgagaacatctgtaagtgggccttagaaaaccaggagacgctctttcggtggctgcggccacacggaggcaagagtctcctgctgaataacgagctgaagaaaggaccagcgctgtttctgttcataccttttaatcccctggccgaaagtcatcctttaatagacgagatcaccgaagtggccttggagtacaacaactgtcatggggaccaggtggtggagcgtctccttcagcacctgcggcgggtggatgctccagtgctggagtccctggccctggaagtgccggcacagctgccagacccgccaacgatcacagcgtccccctgctgcaacactgtggtgctgccccagtggcactccttctccaggacccacaacgtctgtgaactctgtgtcaaccagacctccgggggcatgaagccgagctcggtcagcgtgccacagtgcagcttttttgaaatggcagcagctctggattctttctacctcaaggagcagaccttttatcatgtggcatcagacagcatagaatgcagcaattttttaacttcctatagccccttcagctactacactgcatgttgcaggaccataagcaggggtgtgtcaggcttcatcgactctgaacaaggtgtctttgaagcccctactgttgcattttcttcccttgagaagaaatgtgaggttgatgccccaagctccgttcctcacattgaggagaacaggtatctctttccagaagtggacatgactagcacaaacttcacaggcctgagctgcagaaccaacaagactctcaacatctaccttttggattcaaatttgttttggttatatgcagagagactgggtgctccgagctccactcaggtgaaagaatttgcggcaattgttgacgtgaaagaagaatctcattacatcttggatccaaagcaagcactgatgaagctcaccctagagtcttttattcaaaacttcagcgttctctatagtcccttgaaaaggcatctcattggaagtggctctgcccagttcccgtctcagcatttaatcactgaagtgacaactgataccttttgggaagtagtccttcaaaaacaggacgttctcctgctctattacgctccgtggtgcggcttctgtccatccctcaatcacatcttcatccagctagctcggaacctgcccatggacacattcactgtggcaaggattgacgtgtctcagaatgaccttccttgggaatttatggtcgatcgtcttcctactgtcttgttttttccctgcaacaggtaatgccaaatttttgtcactggtgggcagttgggattcttttgtggaggtctgaaaatgaaatgggtttaagatgtaaatcattcattatgttcaaaaaatgttcccttaggaaccaggcgtggtggctcatgcctgtaatcccagcactttgggaggctgaggcaggcagattgcttgagctcaagaggttgagaccagcctggccgacatggtgaaaccccatcagtacaaaaaatacaaaaattagccaggcatggtgacatatgcttgtaatcccagctactctgaggctgaggcacgagaatctcttgaacctgggatgcggaggttgcagtgagccaagatcacaccactgcactccaacctgggtgacagagcgaggctctgcctcaaaaaaaaaaaaaaaaaaaaagtgtccttagggacataaaagggttgtagtgtcaggatgttatgtgtggtatggatcttttaaaggttgtttttcccagtctatctcttacccgagcttgaatgtggccgtgagaattcttagctttcatggcctgtatgaacatatggaggacgcagagactgacaggattcttctgttgccctggctggagtgcagtggtgcaatgtttgtgtggggcaaaacagcagagaatctgtggagccctgcctgccccaagccttccacttgcttgtctctcagttggcctcccagcagctcctcat

SEQ ID NO: 373074 - DNA, 395 bp, Homo sapiens
tatatacacacatatatgtgtacatatacatgcgtacatatatatacgcatacacattgtgaaatgattgccacaatcaagtttattgtacattcttacatcttttcaactttgggttgcagaaaaaaatagaacaaccatttcaatttaaattttagataaacaatgaattttttttctttagtatgggtatctccatgcaatatttgggcatatttaaacctcattgtttatcagatagtcgaaattcaagtgcccatactgtgttttggtttgttttggctaaatctggcaaaatagtttataatttaaaaaatataattagtcagatgctaatcacttattcagagatgacttcaaccacccaggaaactgtccagatttcataatttagc

SEQ ID NO: 373075 - DNA, 484 bp, Homo sapiens
ttttttttttttgaatcagtcaattttattccaattcttcacaatttacactcaatatgttgtttccaaaatgtaagtcaccctttatataatagttttattatttcatctttcttttagagtttttttaaaatcttttccttatgtttcttcagtagaagccagaatcttgagttgcccagttaggagcctctgacctgctattgtcattaagtttcttctcaatattcatgggccaaaatctagcttctaaaaggaaagggcttttgggtcttttcaatcacttgctgataggggtgagaggtacattgttaccataaccacatggacctaatttaggaatcaatcttgggcatccagtcttggcatttctaatcacatttacaatccacctttcagtttcatctggagtcatgttcaatttgtctgccaacatgttaatgctgatacactggtggatgtgacagaaagtctcaaatatgaa

SEQ ID NO: 373076 - DNA, 509 bp, Homo sapiens
tcatcaaactctgtttttagacttttaccttcaaaccacccaagaacattagagcctcataaactataaatgattaattttatgactcactatttaaagcaaatggaaattttaaacttgtttttatcatgagagtccctgtctggcaataattgggcaaagaaggcaagataaaaaacggatttttcttcaggatctgctaagtagaaacaacaacatagaggctgggcgcagtgactcatgcctgtaatcccagcattttgggaggccaaggtgtgtggatcacctgaggtcaggagttcgagaccagcctggccaacatggcaaaacccagtctctactaaaaatacaaaaattagctgggcatggtggggtgtgcctgtagtcccaaccacttgggaggctgaagcaggagaatcacttgaacttgggaggtggtggttgtggtgagctgagatcatgccactgcactccagcctgggcgacagagtgagactatgtctccaaaa

SEQ ID NO: 373077 - DNA, 388 bp, Homo sapiens
gctgtcctctttaaaacagaaagcaaagctgaagacagaatccaaaatcctggctctggtcctagttcagacactagctgtgaaagtcaggtaagtcccttttttctttgggcttccatttctactaatttctagaaaagttatactgttactctgaaagatttttcttatgtttttgttaccaattttcttagtaaatgcattgcatatgttgaatagtattgtcaacatgtgcaatgcatttacttaaaaaaagacgtatctggcctggcacggtggctcacgctggtaatcccagcactttgggaggctgaggctggtggatcatgaagtcaggagatagagaccatcctggctaacacggtgaaacccagtctctactaaaaaa

SEQ ID NO: 373078 - DNA, 220 bp, Homo sapiens
ggcctttaaatgctctcctatccaaatgattttctatcctggaaatgacacagttaactggatgagtggtatacagaccaagtctaatcgagaattctatcgttatgccaactcaaaagtggtttatgtggattctgcagttttacattactgtaataagtaaatgaggacgtcagtactaagtacatcctttcttagccattcagaacctttctaaatg

SEQ ID NO: 373079 - DNA, 719 bp, Homo sapiens
tattgttggataatgttctgacccagatgctgttattcataaatgggagtgttgccttccatatcgattcctgaattgggcctctgtttcctagatgacgtcactgaggtaagggcgggttaaagcctgtcctataccaagcaagttgtgcagccaactgggggactgaatcccagtgtgatgtgatgaagaggtgttgaaggtccaccaccagtgccagtgaagtttgtgccaagaggtctgattttcatctctcccctctaaatggccacggggaccccagtcaatgtttcccattaacatagactgttgtctggccaaggggccaagacactgagtccaaggaggggggtgagaaatatcaaagggagcccattccatataatccatacaatttgagtgatggggctgggagtgattggtgaacacgccagtaacattaataaagctgaggcctaataaatacataatttttccatggtgacttaaccatgcctgagattggactgcaagacagctgcagttgagtgacgtatcctcatggtgatatcataaagggagtccttccaatgggccggtgtaattgatgctattgctctgtgtcagacggagttaggggtcctggtgcccacgctccctgatcataatatatctcaggaggagtgtcgctccagagtaccagtcgtactaccagtgggttaggaacatatgcccaatat

SEQ ID NO: 373080 - DNA, 444 bp, Homo sapiens
tgcctgaccctggcgctccagtagtttctcagcttcttgtgtcgttttcttgatctgtccccatgttatggggttggatgtcattgtgactccggtcggcccttgttctgtctttgcattcagattccgctggctcatggctcgtactggaggtaacaggcccacggttgaataccatggatccctccggtctcccgttccatggtcacacacacctggagggcacccacacggtttgtccatctcctgtaaaaacacaagcataccctcgtccccacgtcagcaaatccaccggacctttccattgtccttcttctggggatttccataacacttttggataaacttgcctcttttcctctagcagttgccagtgtcgttctgctggggtcttgccatccgtaccaggagtcaaacaatttaaagtaaacaaggctaaatgta

SEQ ID NO: 373081 - DNA, 759 bp, Homo sapiens
tagtcagcctctcactctctacccgctgggcggtaccccgcatctcgctctggccgccccagaggttcgcggcttctggacctgctgtgcccctctccagcctggatcaggacggagaacacccccgaaacccacctcaccagcacagccggcggacccttccggaggtggccgcagagactagccaacttgcgcgcccgccgacccggaccacagctcccagcacacctcaagggcccacgcccgccaggactacaattcccggcgtcctccggaagctcaagtgtacccaggcgcggtgcctgctgggaattgtagttgacgttggtcagcacggaggccacaggatcccagcccggcctttgtgggactgaggtggcgctgagtgggagagcagcaggcgatgcgcgaaaggcgggacttggagataaatactgagcacccacaacaggcagccagcaccactgcagattggatactgcaatgatgataagcatggcctgcctttatggaggttctggatgttcctgtggataacctcaaggagcacgggacctgggacatgactgcccccagcattccttctggcggcagacagagtttgtcagttcgccaacatcctgctttcatgagaacagtttgctgtttgctcacagagcctccagtggtatactgagttggtcacgaccctcattccttcggcctccaacatctccccttttgtttttgcattaattgaataaaggtaatttcaggctg

SEQ ID NO: 373082 - DNA, 1135 bp, Homo sapiens
tagtcagcctctcactctctacccgctgggcggtaccccgcatctcgctctggccgccccagaggttcgcggcttctggacctgctgtgcccctctccagcctggatcaggacggagaacacccccgaaacccacctcaccagcacagccggcggacccttccggaggtggccgcagagactagccaacttgcgcgcccgccgacccggaccacagctcccagcacacctcaagggcccacgcccgccaggactacaattcccggcgtcctccggaagctcaagtgtacccaggcgcggtgcctgctgggaattgtagttgacgttggtcagcacggaggccacaggatcccagcccggcctttgtgggactgaggtggcgctgagtgggagagcagcaggcgatgcgcgaaaggcgggacttggaggttctggatgttcctgtggataacctcaaggagcacgggacctgggacatgactgcccccagcattccttctggcggcagacagagtttgtcagttcgccaacatcctgctttcatgagaacagtttgctgtttgctcacagagcctccagtggtatactgagttggtcacgaccctcattccttcggcctccaacatctccccttttgtttttgcattaattgaataaaggtaatttcaggctggacgtcactgaggtaagggcgggttaaagcctgtcctataccaagcaagttgtgcagccaactgggggactgaatcccagtgtgatgtgatgaagaggtgttgaaggtccaccaccagtgccagtgaagtttgtgccaagagattccgctggctcatggctcgtactggaggtaacaggcccacggttgaataccatggatccctccggtctcccgttccatggtcacacacacctggagggcacccacacggtttgtccatctcctgtaaaaacacaagcataccctcgtccccacgtcagcaaatccaccggacctttccattgtccttcttctggggatttccataacacttttggataaacttgcctcttttcctctagcagttgccagtgtcgttctgctggggtcttgccatccgtaccaggagtcaaacaatttaaagtaaacaaggctaaatgta

SEQ ID NO: 373083 - DNA, 1164 bp, Homo sapiens
  misc_feature (778)..(778): n is a, c, g, or t
tagtcagcctctcactctctacccgctgggcggtaccccgcatctcgctctggccgccccagaggttcgcggcttctggacctgctgtgcccctctccagcctggatcaggacggagaacacccccgaaacccacctcaccagcacagccggcggacccttccggaggtggccgcagagactagccaacttgcgcgcccgccgacccggaccacagctcccagcacacctcaagggcccacgcccgccaggactacaattcccggcgtcctccggaagctcaagtgtacccaggcgcggtgcctgctgggaattgtagttgacgttggtcagcacggaggccacaggatcccagcccggcctttgtgggactgaggtggcgctgagtgggagagcagcaggcgatgcgcgaaaggcgggacttggagataaatactgagcacccacaacaggcagccagcaccactgcagattggatactgcaatgatgataagcatggcctgcctttatggaggttctggatgttcctgtggataacctcaaggagcacgggacctgggacatgactgcccccagcattccttctggcggcagacagagtttgtcagttcgccaacatcctgctttcatgagaacagtttgctgtttgctcacagagcctccagtggtatactgagttggtcacgaccctcattccttcggcctccaacatctccccttttgtttttgcattaattgaataaaggtaatttcaggctgaaaaaaaaaaaaaaaaaanaaaaaaaaaaaaaaaggggggggccctttttttttttttgttttttagtaaaaaaaagttttttttgtgggcccggcaaaacacttttttggggcggggaaaacgtttacaatcgacatttttcggggaaaatatattctgcccgacaccacccgcttcttttttctgaggggggaacaagcccccacgcgtggtataacggcgatgcacacggcggcacaaaactatcctaaggtcatcagagacaatcgtcgggcccgggggaacacacgatgcacccctcgggagaacaacagaaaggtggtcctccccacaaattgtgtacaggggcgtgtgaaaacaacagcccgtcgtgggaggaatacagcgggacagataggaacaac

SEQ ID NO: 373084 - DNA, 1248 bp, Homo sapiens
  misc_feature (691)..(691): n is a, c, g, or t
tagtcagcctctcactctctacccgctgggcggtaccccgcatctcgctctggccgccccagaggttcgcggcttctggacctgctgtgcccctctccagcctggatcaggacggagaacacccccgaaacccacctcaccagcacagccggcggacccttccggaggtggccgcagagactagccaacttgcgcgcccgccgacccggaccacagctcccagcacacctcaagggcccacgcccgccaggactacaattcccggcgtcctccggaagctcaagtgtacccaggcgcggtgcctgctgggaattgtagttgacgttggtcagcacggaggccacaggatcccagcccggcctttgtgggactgaggtggcgctgagtgggagagcagcaggcgatgcgcgaaaggcgggacttggaggttctggatgttcctgtggataacctcaaggagcacgggacctgggacatgactgcccccagcattccttctggcggcagacagagtttgtcagttcgccaacatcctgctttcatgagaacagtttgctgtttgctcacagagcctccagtggtatactgagttggtcacgaccctcattccttcggcctccaacatctccccttttgtttttgcattaattgaataaaggtaatttcaggctgaaaaaaaaaaaaaaaaaanaaaaaaaaaaaaaagaaagaaaaaacaaaacaaaaaaaaaaaaaaaaacaaagaggggggcgcgcgccgccaaaaaatatacacccccgccgggggcggccccaaatagcgcgcgaccaccgcaggacgtggtgtgaaaaagaaggggcccccaaattaggagggcgtgtcatataaaacacacagacgacggggacggagagtataaacaagagggataacgggggaaaaaataggacacacgacgacgagcaacttgatgaagagagaaaccacatcacatatcggagagcgggggggagcaacaatctggcggggagccaacacaactctccaccacaacagcgaagatacacacccccaccaaagggggggacaaacaacacaaacacggccagcgagcgggaacataaggagggcggcacaaccacaggccgacaacaactccgcccccccggcgccaaaaaaaaaaggggtgcccaccagaggggacgctgcaccccatcacgcaccgaaattatatcaaccagcggggaacgaacaaaaaaaacacgcgg

SEQ ID NO: 373085 - DNA, 1476 bp, Homo sapiens
tagtcagcctctcactctctacccgctgggcggtaccccgcatctcgctctggccgccccagaggttcgcggcttctggacctgctgtgcccctctccagcctggatcaggacggagaacacccccgaaacccacctcaccagcacagccggcggacccttccggaggtggccgcagagactagccaacttgcgcgcccgccgacccggaccacagctcccagcacacctcaagggcccacgcccgccaggactacaattcccggcgtcctccggaagctcaagtgtacccaggcgcggtgcctgctgggaattgtagttgacgttggtcagcacggaggccacaggatcccagcccggcctttgtgggactgaggtggcgctgagtgggagagcagcaggcgatgcgcgaaaggcgggacttggagataaatactgagcacccacaacaggcagccagcaccactgcagattggatactgcaatgatgataagcatggcctgcctttatggagttcaaggcatgtggtgatcatgctgcctaagagtatctttgtttacctgaggaccttgggccatgccaagtatttgtcaacaatgtgatttatggttctggatgttcctgtggataacctcaaggagcacgggacctgggacatgactgcccccagcattccttctggcggcagacagagtttgtcagttcgccaacatcctgctttcatgagaacagtttgctgtttgctcacagagcctccagtggtatactgagttggtcacgaccctcattccttcggcctccaacatctccccttttgtttttgcattaattgaataaaggtaatttcaggctggacgtcactgaggtaagggcgggttaaagcctgtcctataccaagcaagttgtgcagccaactgggggactgaatcccagtgtgatgtgatgaagaggtgttgaaggtccaccaccagtgccagtgaagtttgtgccaagaggtctgattttcatctctcccctctaaatggccacggggaccccagtcaatgtttcccattaacatagactgttgtctggccaaggggccaagacactgagtccaaggaggggggtgagaaatatcaaagggagcccattccatataatccatacaatttgagtgatggggctgggagtgattggtgaacacgccagtaacattaataaagctgaggcctaataaatacataatttttccatggtgacttaaccatgcctgagattggactgcaagacagctgcagttgagtgacgtatcctcatggtgatatcataaagggagtccttccaatgggccggtgtaattgatgctattgctctgtgtcagacggagttaggggtcctggtgcccacgctccctgatcataatatatctcaggaggagtgtcgctccagagtaccagtcgtactaccagtgggttaggaacatatgcccaatat

SEQ ID NO: 373086 - DNA, 853 bp, Homo sapiens
tagtcagcctctcactctctacccgctgggcggtaccccgcatctcgctctggccgccccagaggttcgcggcttctggacctgctgtgcccctctccagcctggatcaggacggagaacacccccgaaacccacctcaccagcacagccggcggacccttccggaggtggccgcagagactagccaacttgcgcgcccgccgacccggaccacagctcccagcacacctcaagggcccacgcccgccaggactacaattcccggcgtcctccggaagctcaagtgtacccaggcgcggtgcctgctgggaattgtagttgacgttggtcagcacggaggccacaggatcccagcccggcctttgtgggactgaggtggcgctgagtgggagagcagcaggcgatgcgcgaaaggcgggacttggagataaatactgagcacccacaacaggcagccagcaccactgcagattggatactgcaatgatgataagcatggcctgcctttatggagttcaaggcatgtggtgatcatgctgcctaagagtatctttgtttacctgaggaccttgggccatgccaagtatttgtcaacaatgtgatttatggttctggatgttcctgtggataacctcaaggagcacgggacctgggacatgactgcccccagcattccttctggcggcagacagagtttgtcagttcgccaacatcctgctttcatgagaacagtttgctgtttgctcacagagcctccagtggtatactgagttggtcacgaccctcattccttcggcctccaacatctccccttttgtttttgcattaattgaataaaggtaatttcaggctg

SEQ ID NO: 373087 - DNA, 672 bp, Homo sapiens
tagtcagcctctcactctctacccgctgggcggtaccccgcatctcgctctggccgccccagaggttcgcggcttctggacctgctgtgcccctctccagcctggatcaggacggagaacacccccgaaacccacctcaccagcacagccggcggacccttccggaggtggccgcagagactagccaacttgcgcgcccgccgacccggaccacagctcccagcacacctcaagggcccacgcccgccaggactacaattcccggcgtcctccggaagctcaagtgtacccaggcgcggtgcctgctgggaattgtagttgacgttggtcagcacggaggccacaggatcccagcccggcctttgtgggactgaggtggcgctgagtgggagagcagcaggcgatgcgcgaaaggcgggacttggaggttctggatgttcctgtggataacctcaaggagcacgggacctgggacatgactgcccccagcattccttctggcggcagacagagtttgtcagttcgccaacatcctgctttcatgagaacagtttgctgtttgctcacagagcctccagtggtatactgagttggtcacgaccctcattccttcggcctccaacatctccccttttgtttttgcattaattgaataaaggtaatttcaggctg

SEQ ID NO: 373088 - DNA, 1295 bp, Homo sapiens
tagtcagcctctcactctctacccgctgggcggtaccccgcatctcgctctggccgccccagaggttcgcggcttctggacctgctgtgcccctctccagcctggatcaggacggagaacacccccgaaacccacctcaccagcacagccggcggacccttccggaggtggccgcagagactagccaacttgcgcgcccgccgacccggaccacagctcccagcacacctcaagggcccacgcccgccaggactacaattcccggcgtcctccggaagctcaagtgtacccaggcgcggtgcctgctgggaattgtagttgacgttggtcagcacggaggccacaggatcccagcccggcctttgtgggactgaggtggcgctgagtgggagagcagcaggcgatgcgcgaaaggcgggacttggaggttctggatgttcctgtggataacctcaaggagcacgggacctgggacatgactgcccccagcattccttctggcggcagacagagtttgtcagttcgccaacatcctgctttcatgagaacagtttgctgtttgctcacagagcctccagtggtatactgagttggtcacgaccctcattccttcggcctccaacatctccccttttgtttttgcattaattgaataaaggtaatttcaggctggacgtcactgaggtaagggcgggttaaagcctgtcctataccaagcaagttgtgcagccaactgggggactgaatcccagtgtgatgtgatgaagaggtgttgaaggtccaccaccagtgccagtgaagtttgtgccaagaggtctgattttcatctctcccctctaaatggccacggggaccccagtcaatgtttcccattaacatagactgttgtctggccaaggggccaagacactgagtccaaggaggggggtgagaaatatcaaagggagcccattccatataatccatacaatttgagtgatggggctgggagtgattggtgaacacgccagtaacattaataaagctgaggcctaataaatacataatttttccatggtgacttaaccatgcctgagattggactgcaagacagctgcagttgagtgacgtatcctcatggtgatatcataaagggagtccttccaatgggccggtgtaattgatgctattgctctgtgtcagacggagttaggggtcctggtgcccacgctccctgatcataatatatctcaggaggagtgtcgctccagagtaccagtcgtactaccagtgggttaggaacatatgcccaatat

SEQ ID NO: 373089 - DNA, 1485 bp, Homo sapiens
tagtcagcctctcactctctacccgctgggcggtaccccgcatctcgctctggccgccccagaggttcgcggcttctggacctgctgtgcccctctccagcctggatcaggacggagaacacccccgaaacccacctcaccagcacagccggcggacccttccggaggtggccgcagagactagccaacttgcgcgcccgccgacccggaccacagctcccagcacacctcaagggcccacgcccgccaggactacaattcccggcgtcctccggaagctcaagtgtacccaggcgcggtgcctgctgggaattgtagttgacgttggtcagcacggaggccacaggatcccagcccggcctttgtgggactgaggtggcgctgagtgggagagcagcaggcgatgcgcgaaaggcgggacttggagataaatactgagcacccacaacaggcagccagcaccactgcagattggatactgcaatgatgataagcatggcctgcctttatggaggtgatgttattgtgtggggaggcagatggtaaacaaagaagtcatttttctgagaagttggtatttaagctgaggcctgaatagagcgaagaactcagggagagttctggatgttcctgtggataacctcaaggagcacgggacctgggacatgactgcccccagcattccttctggcggcagacagagtttgtcagttcgccaacatcctgctttcatgagaacagtttgctgtttgctcacagagcctccagtggtatactgagttggtcacgaccctcattccttcggcctccaacatctccccttttgtttttgcattaattgaataaaggtaatttcaggctggacgtcactgaggtaagggcgggttaaagcctgtcctataccaagcaagttgtgcagccaactgggggactgaatcccagtgtgatgtgatgaagaggtgttgaaggtccaccaccagtgccagtgaagtttgtgccaagaggtctgattttcatctctcccctctaaatggccacggggaccccagtcaatgtttcccattaacatagactgttgtctggccaaggggccaagacactgagtccaaggaggggggtgagaaatatcaaagggagcccattccatataatccatacaatttgagtgatggggctgggagtgattggtgaacacgccagtaacattaataaagctgaggcctaataaatacataatttttccatggtgacttaaccatgcctgagattggactgcaagacagctgcagttgagtgacgtatcctcatggtgatatcataaagggagtccttccaatgggccggtgtaattgatgctattgctctgtgtcagacggagttaggggtcctggtgcccacgctccctgatcataatatatctcaggaggagtgtcgctccagagtaccagtcgtactaccagtgggttaggaacatatgcccaatat

SEQ ID NO: 373090 - DNA, 892 bp, Homo sapiens
tagtcagcctctcactctctacccgctgggcggtaccccgcatctcgctctggccgccccagaggttcgcggcttctggacctgctgtgcccctctccagcctggatcaggacggagaacacccccgaaacccacctcaccagcacagccggcggacccttccggaggtggccgcagagactagccaacttgcgcgcccgccgacccggaccacagctcccagcacacctcaagggcccacgcccgccaggactacaattcccggcgtcctccggaagctcaagtgtacccaggcgcggtgcctgctgggaattgtagttgacgttggtcagcacggaggccacaggatcccagcccggcctttgtgggactgaggtggcgctgagtgggagagcagcaggcgatgcgcgaaaggcgggacttggagataaatactgagcacccacaacaggcagccagcaccactgcagattggatactgcaatgatgataagcatggcctgcctttatggagaaagccaacaaaatcatttgtgaccctggtttctttcagttcaaggcatgtggtgatcatgctgcctaagagtatctttgtttacctgaggaccttgggccatgccaagtatttgtcaacaatgtgatttatggttctggatgttcctgtggataacctcaaggagcacgggacctgggacatgactgcccccagcattccttctggcggcagacagagtttgtcagttcgccaacatcctgctttcatgagaacagtttgctgtttgctcacagagcctccagtggtatactgagttggtcacgaccctcattccttcggcctccaacatctccccttttgtttttgcattaattgaataaaggtaatttcaggctg

SEQ ID NO: 373091 - DNA, 371 bp, Homo sapiens
gctctgtctcaaaaaaaaaaaaaaaaagtagttagttaatgcaaaaagctcctatcttctagactgttagaatttgatggggttgggccgagcgcggtggctcatgcctataatcccagcactttgggaggccaaggtgggcggatcatgaggtcaggagatagaggccatcctggctaatatggtgaaaccccatctctactaaaactacaaaaaattagccagatgtggtggcacatgcctgtagtcccagctgctcgggaggctgaggcaggagaatcgcttgaacccgggaggcagaggttgcagtgagctgagattgcaccagtgcacaccagcctggtgacagagcgagactccatctcaaaaaa

SEQ ID NO: 373092 - DNA, 1002 bp, Homo sapiens
aacagtggtatcaacgcagagtgcccattacggccggggacttctaaatgcttggggaaaccaagacatagtagaaaggagtgtgcaattatcatttcccatgatgccgttacttaagaactctttgtgtccgtccttctaatggcaccaatgcctcccatcaagccttaaacctcacctaaattatgtcattgggctttttcatccataaatgagcataccaggtgccaagggaatcaatatgccctttcacatgccttagaccagtgtccaaagaaagataaaatgttattctataaaagctttctcccagcatttctattcctttacattttgtgccatatacaactatggttttttaatgatcttatttctgacagctgtttttcttcagaacatcaacagcttctttcctaaattagttttagtatgagttccatttctaattagctcaaattaaagtcctagagagcagcgaggtaatatttaaaccctcaggctaaatttcggagtaggtgcagaatgttgactctaaatgagtttttcctgtgacataacacgcatgaaaccaggatttctttcatgtgtgaaatgtcttaaatcagacttaccctttgtgattctcttttagctttaaatgtcatttaagaagaaaaaagaaaagaaaattaagcatgacattccccaatatcctctgctcactgtgttataatccctatcactccacaagtgaattggagagagtgaagacacaatgaacagaaacttccctgatgcttcacagaggaagtgttctccgggaccacacagcctccaccatgtccatctacgaagggctgtggcaagccatatacacaaagatgcctgtttcctgtcttcttggttaaaaacaaaaacaaaacactggaaggaaccccaaagccaagctgccatgggttgcagagtgccagcccttaagtagtgttgttcatgggtaaacaggagacggataagggcaatttc

SEQ ID NO: 373093 - DNA, 429 bp, Homo sapiens
tctcattagattaaaaacacatgttgaatctccacactgtagataagccaatttttcctaagctgttaaaggaaaaagtggggttcttgtgggcttgggagaagcacctgctttgaattaagctgtgtttgtattaaccactgtcaatttaacaagggtttgctctgtgtgctttgagcaatttgagggagaagtccctagatgcttatcaagtattactgtcattactatagttcactgtttcattacattatagtaatactgatggctgtcaattgttttgaaatgcttttttctgtattctatttaatttactgagatatggagaaaatcgtcgaaggaattagtgtatctgggtcaacaatttggctgaccaatcactagacttcttttggcttcatactgagaaataaaaatctctaacccata

SEQ ID NO: 373094 - DNA, 882 bp, Homo sapiens
  misc_feature (29)..(29): n is a, c, g, or t
gtagcagtaggagctggtgttaattcggncgagctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373095 - DNA, 438 bp, Homo sapiens
atttcttgaggatccccgaacggccctaataaccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373096 - DNA, 844 bp, Homo sapiens
gacgaccggaaacaaaagtcatgatgaagaagggaacctggcttggcggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaaaaaaaaaaataaaaatggcctcttcggcctgacggtggagctggggggcactagcctttaggagggcaatcagttgtgctgagctacttactatctggtaggactgttagatgaggtagcgggttagcggactcaaaggtcgaatacggtgtgcccgaataggggataccgcgcaataaccttggtgcccaggctacatatggcttaacctagtaaggcctttt

SEQ ID NO: 373097 - DNA, 880 bp, Homo sapiens
tagtaaggccggtgttaatcggcgagggacgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373098 - DNA, 915 bp, Homo sapiens
gcttcccccccgcccacgccccccccccactgcattgtatgcccagtgggtttttatcggcacgagctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373099 - DNA, 898 bp, Homo sapiens
  misc_feature (17)..(17): n is a, c, g, or t
ccatgctggtacggccncgcgtattggctatcgtcgaccaggcgctcggctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373100 - DNA, 929 bp, Homo sapiens
gtggtattttctgtaagatcaggtgttcctccctcgtaggtttagaggaaacaccctcatagatgaaaacccccccgacgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373101 - DNA, 1196 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaaaaaaaaacaaaaatgggccctcttgggccttaacgggggaagctcctgccgcccgct

SEQ ID NO: 373102 - DNA, 1878 bp, Homo sapiens
  misc_feature (1218)..(1218): n is a, c, g, or t
  misc_feature (1221)..(1221): n is a, c, g, or t
  misc_feature (1232)..(1232): n is a, c, g, or t
  misc_feature (1236)..(1236): n is a, c, g, or t
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaaaaaaaaaaaaaaaaaaaaaaaaaaaaaaaaaaaaaaaaaaaaaaaaaaaaaaaaaaaaaaaaaaaaaaaaaaaaaaaanaanaaaaaaaaaanaaanaaaaaaaggggggggggcgcaaaaacccccgcggtggcggcgaccgcacttacgtgccggctcaccctacgatacttattggtgcaagaagagcggcgcgaccaccacaactgagagcggcaatcatataaaaacagcagcaaagcgcggcgcgacaaaaaaaacaacgctgctggggtgagggaaaaacacgccgaaccgataggatcacttattggaggacgacacacaccacccttaggggtggcggaggcaacagtgagggacacacaaacgactgacaagttatatccccatcgggagacacacaaacacacccgcaacgccggtgatgccagggtacatccaacaagcagcacgaacttacggcgacgggcagcaaaacccgagccgcgcacgcgagaggaacgtcgcacagagcacacacccatacccgcgggggccgactcgtaaatatacaatagtgccaacgaccctacccacaaaccaacacgaacgcgacacgcactacgggaacaagcaaccaccggaccccaacgagaacgagaacacaagacgccgaaaccacacaccaagtcacacaagaaagacgactaacgtacacagaaagcagacgaaccgacaactaacagacaagacaca

SEQ ID NO: 373103 - DNA, 1494 bp, Homo sapiens
  misc_feature (1218)..(1218): n is a, c, g, or t
  misc_feature (1221)..(1221): n is a, c, g, or t
  misc_feature (1232)..(1232): n is a, c, g, or t
  misc_feature (1236)..(1236): n is a, c, g, or t
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaaaaaaaaaaaaaaaaaaaaaaaaaaaaaaaaaaaaaaaaaaaaaaaaaaaaaaaaaaaaaaaaaaaaaaaaaaaaaaaanaanaaaaaaaaaanaaanaaaaaaaaataaaaatgaggaaaattatcaatatacaaaaaaaaaaaaaacttggggccggtttgggccatttgattttaaaatttggaaagtttattttcgcggccccattttgggctaatttggccaaatccccccttaggggggcggttaacaaattatggggccgggttttaaaaccgctggatgtgaaaaaccctgggtgtccccatttaaatcgtttgtaaaaataccctcttcgcaagtggggtaaaaacc

SEQ ID NO: 373104 - DNA, 1246 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaaggtggtcgcgaaaaaagaaaatcgggcacagggggggaacaggaggaaggcgggccaggtcgccctttgccacgggaacgggcccaaggggatgacgcgaggaaaca

SEQ ID NO: 373105 - DNA, 1172 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaaaacacacaacacggttcgacacaaaaaagaggg

SEQ ID NO: 373106 - DNA, 1659 bp, Homo sapiens
  misc_feature (1141)..(1141): n is a, c, g, or t
  misc_feature (1147)..(1147): n is a, c, g, or t
  misc_feature (1152)..(1152): n is a, c, g, or t
  misc_feature (1155)..(1155): n is a, c, g, or t
  misc_feature (1157)..(1157): n is a, c, g, or t
  misc_feature (1161)..(1161): n is a, c, g, or t
  misc_feature (1164)..(1164): n is a, c, g, or t
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaaanaaaaancacancananaacnacnaacaacacatcttgtttcgggccggcctaggagcctgaggagagggatgtttagaaccaattctcgttgtggtgcccgggcgccccaaggattgttacagctgaccccgtgggccaagatacgtgctagccacaagagagcaccgtgcggcagcagcactaggtcgttgccgtttcttcaccaaataaaaaaaccgcgggcgcgacacggagcgtttctggaacgacactccagatcggttccgagggcacataaagcggggctctatcacacaggggggccagcgggagcgcccgaaataaaaatcccgccgcgcgcggagagatacacgagcagaaaaaagacaaaaacaacaaaagaacaagcagacaaaagcacagcacaaggagaaaggaacaagacacaaaaagacagacacagacaagaaacgaacataaaaacagaaaaaaagaaaagacaaaaacagaaaaataacacacacccaaataaaataac

SEQ ID NO: 373107 - DNA, 1255 bp, Homo sapiens
  misc_feature (1239)..(1239): n is a, c, g, or t
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaatataaaaaacaaaagtaggggggccccaaggataaaaaagctgggagaagggtaatggatcgccgccacaatgtaagctctcattggccatttccccctntaaggtaaaccaattc

SEQ ID NO: 373108 - DNA, 809 bp, Homo sapiens
aggcatacaccgactgggccagcggcgcccgagaagcatacaccgactgggccgcccgtcggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373109 - DNA, 1243 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagacagggagttccataatatgcgggtgggaaaaaaaaaaaccgggtttgtggggcgaaggttgaggcctggatgtctgcccgttgagggaatgggccttgggtatcgacgactgttaaaaaccgagagagaagagggatggggatggagag

SEQ ID NO: 373110 - DNA, 1001 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373111 - DNA, 1475 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggtgcgccgggcggagcggggcggggcgggggcggacgtgcagtagtggctgggggcgccggcggtgtgctggtgggtgccgtcggctccatgcgcggagagtctggctactctctcgtttcctttctgttgctcgtagctgctgaaattcctctccgcccttgggattgcgcatggagggcaaaatcccggtgactcatagaaaatctcccttgtttgtggttagaacgtttctctcctcctcttgaccccgggttctagctgcccttctctcctgtaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaaaaaaaaacaaaaatgggccctcttgggccttaacgggggaagctcctgccgcccgct

SEQ ID NO: 373112 - DNA, 1137 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgaggggggattatgtttggggggggggttttcgggggtttttgttttgggggttttggttggggggggtgggggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373113 - DNA, 1026 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaatagatattggccttctttggcctta

SEQ ID NO: 373114 - DNA, 975 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373115 - DNA, 328 bp, Homo sapiens
gtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaacagaactgtgtgtatgtcctgtg

SEQ ID NO: 373116 - DNA, 1139 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373117 - DNA, 1162 bp, Homo sapiens
  misc_feature (1151)..(1151): n is a, c, g, or t
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaaaaaaaaaaaaantctccagggcg

SEQ ID NO: 373118 - DNA, 958 bp, Homo sapiens
  misc_feature (26)..(26): n is a, c, g, or t
  misc_feature (37)..(37): n is a, c, g, or t
  misc_feature (910)..(910): n is a, c, g, or t
ggtggacattgaggattaacgcctgncgccccccccnggaggtacgggatgcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaaaaaaaaanacaaaaaaaaaggggggggaaaaaatccccggggggccatagggtcca

SEQ ID NO: 373119 - DNA, 577 bp, Homo sapiens
  misc_feature (26)..(26): n is a, c, g, or t
  misc_feature (31)..(31): n is a, c, g, or t
  misc_feature (34)..(34): n is a, c, g, or t
acaactttgtgtacataccccacgancttanggnattacgtcagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373120 - DNA, 667 bp, Homo sapiens
ggtgggttcgagcccaacttcatgctcttcgagaagtgcgagggaattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaaagaaacaaaaagaaacaacatcagattatctaaccctgcaacagaaaagacaaacaaatcgaaagccaaaa

SEQ ID NO: 373121 - DNA, 902 bp, Homo sapiens
  misc_feature (26)..(26): n is a, c, g, or t
  misc_feature (37)..(37): n is a, c, g, or t
ggtggacattgaggattaacgcctgncgccccccccnggaggtacgggatgcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373122 - DNA, 1358 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaacgctggcctcgttggcctcagcggtggagctctggggtacgctttcctttacagaggaccaaataatgagtctggctcactgactactccccctcgtttcttctggttgttttcagcggctgaacatcacttatagtttgttcccggttttttacacagcgcgggattctctgcgagcaccgcccgcccctttcacttatttcgcccctacgccccacc

SEQ ID NO: 373123 - DNA, 1195 bp, Homo sapiens
  misc_feature (1147)..(1147): n is a, c, g, or t
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaaaaaaaaanacaaaaaaaaaggggggggaaaaaatccccggggggccatagggtcca

SEQ ID NO: 373124 - DNA, 1363 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaaaaaaaaaaataaaaatggcctcttcggcctgacggtggagctggggggcactagcctttaggagggcaatcagttgtgctgagctacttactatctggtaggactgttagatgaggtagcgggttagcggactcaaaggtcgaatacggtgtgcccgaataggggataccgcgcaataaccttggtgcccaggctacatatggcttaacctagtaaggcctttt

SEQ ID NO: 373125 - DNA, 1418 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggtgcgccgggcggagcggggcggggcgggggcggacgtgcagtagtggctgggggcgccggcggtgtgctggtgggtgccgtcggctccatgcgcggagagtctggctactctctcgtttcctttctgttgctcgtagctgctgaaattcctctccgcccttgggattgcgcatggagggcaaaatcccggtgactcatagaaaatctcccttgtttgtggttagaacgtttctctcctcctcttgaccccgggttctagctgcccttctctcctgtaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373126 - DNA, 626 bp, Homo sapiens
tctatgccacccgcatgtaggtccggccgctatatctacagcaggtttttgggggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373127 - DNA, 1109 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373128 - DNA, 1089 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagcctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 373129 - DNA, 2399 bp, Homo sapiens
aacggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaaaaatggctactggacaggatcgagtggttgctctcgtggacatggactgtttttttgttcaagtggagcagcggcaaaatcctcatttgaggaataaaccttgtgcagttgtacagtacaaatcatggaagggtggtggaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtcctggcaaaactggcctgtggactaaacaagcccaaccgccaaaccctggtttcacatgggtcagtcccacagctcttcagccaaatgcccattcgcaaaatccgtagtcttggaggaaagctaggggcctctgtcattgagatcctagggatagaatacatgggtgaactgacccagttcactgaatcccagctccagagtcattttggggagaagaatgggtcttggctatatgccatgtgccgagggattgaacatgatccagttaaacccaggcaactacccaaaaccattggctgtagtaagaacttcccaggaaaaacagctcttgctactcgggaacaggtacaatggtggctgttgcaattagcccaggaactagaggagagactgactaaagaccgaaatgataatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgc

SEQ ID NO: 373130 - DNA, 793 bp, Homo sapiens
aacggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaaggtacttccatagcatcatactgcttctgcttcctgcctttggaacctgctttgcttggtcatgctgattctccttggaataattgaaaggaaacttaaatccagcctgggtggcgacagagcaagactctgtctcaaaaaaaaaaaaga

SEQ ID NO: 373131 - DNA, 405 bp, Homo sapiens
gcatgagccaccacgcccagcctatagtactgtattcttattctccactcttgtgtgtgaaaagtcagctcttttggcttttctgttatggggaaacttgaattacacagggaacccaactgaagaaaatgaactgaagtaggtggcgctgggtgaagtgggcccagagaatggtgtacacatccctcccatacatatacccaaacttctatttttttatgtgacggagtttctctcatcgccccggcgagattgcgccattgcactccagcctgggcaaaagagtgagactccttctaaaaaaaaaacaaaaaaacaaaaaacaaacataaagttggcacagaaaagggaccaagtttaaaaaagggttttaaatgtaatgagacttgcatagttaaaaaaaaa

SEQ ID NO: 373132 - DNA, 4366 bp, Homo sapiens
aacggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaaaaatggctactggacaggatcgagtggttgctctcgtggacatggactgtttttttgttcaagtggagcagcggcaaaatcctcatttgaggaataaaccttgtgcagttgtacagtacaaatcatggaagggtggtggaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtcctggcaaaactggcctgtggactaaacaagcccaaccgccaaaccctggtttcacatgggtcagtcccacagctcttcagccaaatgcccattcgcaaaatccgtagtcttggaggaaagctaggggcctctgtcattgagatcctagggatagaatacatgggtgaactgacccagttcactgaatcccagctccagagtcattttggggagaagaatgggtcttggctatatgccatgtgccgagggattgaacatgatccagttaaacccaggcaactacccaaaaccattggctgtagtaagaacttcccaggaaaaacagctcttgctactcgggaacaggtacaatggtggctgttgcaattagcccaggaactagaggagagactgactaaagaccgaaatgataatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtgggccttggagtctaagagacgtggttgcaaacttagctctggttattgcaatgagggccttgaacaagtcattttcttcacattctcatctgtaaaatggagataataccttacagattattgcagattaataacaatgtattcaaattatgtaactcggccgggtacaatggctcacgcctgtaatcctaacactttgggaggccgaggcagacagatcacctgaggtcaggagtttgagaccagcctggccaacatggcaaaaccatctctactaaaaatagaaaaattagccaggcacgttccaggcacctgtgatcccagctacttagaggctgaggcagaagaattgctttaaccttggaggcggaggttgcattgagctgagatcatgctagtgcgctccagcctgggcaacagagcgagacttcatctcagaaaataaaaaataggggccaggcacagtggctcatacctgtaatgccagcactttgggaggccaaggcgggcagatcacgaggtcaggagtttcagaccaatatggtgaaaccccatctctactaaaattacaaaaaaaattatccaggcgtggtggtgcacgcctgtaatcccagctactcaggaggctaaggcaggagaatcacttgaacccaggaggcagaggttggagtgagctgagatcgcgccaccgcactccagcctgggcaacagagcgagactccatctcaaacaaaaacaagaacaaaaacaaacataaagttggcacagaaaagggaccaagtttaaaaaagggttttaaatgtaatgagacttgcatagttaaaaaaaaaaaaaaaaaaaaaaaaaaaaaaaaaaaaaaaaaaaaaaaaacaaaagaaaaacttctctctagctctgtgacgggcagttcagataataccttcaccagatttacctgttttcagctgaagaatgtgagatgaagccttgaaaccctaaaagtgatatggtaactagggcaggtctttctgtacataaaagtgacttaataaacagtgaatttcatacaggtaaaccctattataccctcagttctaaccattggcctatctcttgcgttttgttctaatgtagaattagattgctacttgactagttcaggaactctgtttagatctgataagtcataatcaaatcttgccaggctgctgggattacaggcctgagccaccaggccagccccaacttctactttttattttatttataaattggggggggggttctatatttagtttgaagaggtggggaagatttgaaaaccactagatttaccaggaaatttttttcttcaaaaatattttctgcttttatgatacttgaatatctaataaaagacaatatttagccagtcacggtggctgatgcttgtaatcctaacactttgggaggctgaggtgggtggactactggagccctggagttcaaaaccggcctaagccacatggcaaaacagtctttacaaaaaatacaaagatggtggcttatgcctgtagtcgtacctactcaggaggctgaggttgggaggatcacctgaatctgggagtttggggctgcaataagccatgattgtgccgctgcactccagcctgggtgacagtctgagaccctgtctcaaaa

SEQ ID NO: 373133 - DNA, 3459 bp, Homo sapiens
aacggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaaaaatggctactggacaggatcgagtggttgctctcgtggacatggactgtttttttgttcaagtggagcagcggcaaaatcctcatttgaggaataaaccttgtgcagttgtacagtacaaatcatggaagggtggtggaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtcctggcaaaactggcctgtggactaaacaagcccaaccgccaaaccctggtttcacatgggtcagtcccacagctcttcagccaaatgcccattcgcaaaatccgtagtcttggaggaaagctaggggcctctgtcattgagatcctagggatagaatacatgggtgaactgacccagttcactgaatcccagctccagagtcattttggggagaagaatgggtcttggctatatgccatgtgccgagggattgaacatgatccagttaaacccaggcaactacccaaaaccattggctgtagtaagaacttcccaggaaaaacagctcttgctactcgggaacaggtacaatggtggctgttgcaattagcccaggaactagaggagagactgactaaagaccgaaatgataatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtgggccttggagtctaagagacgtggttgcaaacttagctctggttattgcaatgagggccttgaacaagtcattttcttcacattctcatctgtaaaatggagataataccttacagattattgcagattaataacaatgtattcaaattatgtaactcggccgggtacaatggctcacgcctgtaatcctaacactttgggaggccgaggcagacagatcaccaggctggtcttgaactcttgatctcaagtgatccacccgccctggcctcccaaggtgctgggattacaggcctgagccaccaggccagccccaacttctactttttattttatttataaattggggggggggttctatatttagtttgaagaggtggggaagatttgaaaaccactagatttaccaggaaatttttttcttcaaaaatattttctgcttttatgatacttgaatatctaataaaagacaatatttagccagtcacggtggctgatgcttgtaatcctaacactttgggaggctgaggtgggtggactactggagccctggagttcaaaaccggcctaagccacatggcaaaacagtctttacaaaaaatacaaagatggtggcttatgcctgtagtcgtacctactcaggaggctgaggttgggaggatcacctgaatctgggagtttggggctgcaataagccatgattgtgccgctgcactccagcctgggtgacagtctgagaccctgtctcaaaa

SEQ ID NO: 373134 - DNA, 4502 bp, Homo sapiens
aacggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtcctggcaaaactggcctgtggactaaacaagcccaaccgccaaaccctggtttcacatgggtcagtcccacagctcttcagccaaatgcccattcgcaaaatccgtagtcttggaggaaagctaggggcctctgtcattgagatcctagggatagaatacatgggtgaactgacccagttcactgaatcccagctccagagtcattttggggagaagaatgggtcttggctatatgccatgtgccgagggattgaacatgatccagttaaacccaggcaactacccaaaaccattggctgtagtaagaacttcccaggaaaaacagctcttgctactcgggaacaggtacaatggtggctgttgcaattagcccaggaactagaggagagactgactaaagaccgaaatgataatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtgggccttggagtctaagagacgtggttgcaaacttagctctggttattgcaatgagggccttgaacaagtcattttcttcacattctcatctgtaaaatggagataataccttacagattattgcagattaataacaatgtattcaaattatgtaactcggccgggtacaatggctcacgcctgtaatcctaacactttgggaggccgaggcagacagatcacctgaggtcaggagtttgagaccagcctggccaacatggcaaaaccatctctactaaaaatagaaaaattagccaggcacgttccaggcacctgtgatcccagctacttagaggctgaggcagaagaattgctttaaccttggaggcggaggttgcattgagctgagatcatgctagtgcgctccagcctgggcaacagagcgagacttcatctcagaaaataaaaaataggggccaggcacagtggctcatacctgtaatgccagcactttgggaggccaaggcgggcagatcacgaggtcaggagtttcagaccaatatggtgaaaccccatctctactaaaattacaaaaaaaattatccaggcgtggtggtgcacgcctgtaatcccagctactcaggaggctaaggcaggagaatcacttgaacccaggaggcagaggttggagtgagctgagatcgcgccaccgcactccagcctgggcaacagagcgagactccatctcaaacaaaaacaagaacaaaaacaaacataaagttggcacagaaaagggaccaagtttaaaaaagggttttaaatgtaatgagacttgcatagttaaaaaaaaaaaaaaaaaaaagaaaaacttctctttaggctgggtgcggttcctcatgcctataatcccagcatttagggaggctgaggtgagtggattgcaggagctcaggagttcgagaccagcctgggcaaggtggcaaaaccccgtctctactaaaaaaaattagctgggcttggtggcaggcgccgtgtaatcccaggtactcgggagactgaggcaggagaattgcttgaacctggaaggtggaggttgcagtgagttgagatcacaccaatgcactccagccagggtgagagtgagagactgtctcaaaaaaaaaaaaaacaaaagaaaaacttctctctagctctgtgacgggcagttcagataataccttcaccagatttacctgttttcagctgaagaatgtgagatgaagccttgaaaccctaaaagtgatatggtaactagggcaggtctttctgtacataaaagtgacttaataaacagtgaatttcatacaggtaaaccctattataccctcagttctaaccattggcctatctcttgcgttttgttctaatgtagaattagattgctacttgactagttcaggaactctgtttagatctgataagtcataatcaaatcttgccaggctgctgggattacaggcctgagccaccaggccagccccaacttctactttttattttatttataaattggggggggggttctatatttagtttgaagaggtggggaagatttgaaaaccactagatttaccaggaaatttttttcttcaaaaatattttctgcttttatgatacttgaatatctaataaaagacaatatttagccagtcacggtggctgatgcttgtaatcctaacactttgggaggctgaggtgggtggactactggagccctggagttcaaaaccggcctaagccacatggcaaaacagtctttacaaaaaatacaaagatggtggcttatgcctgtagtcgtacctactcaggaggctgaggttgggaggatcacctgaatctgggagtttggggctgcaataagccatgattgtgccgctgcactccagcctgggtgacagtctgagaccctgtctcaaaa

SEQ ID NO: 373135 - DNA, 2090 bp, Homo sapiens
  misc_feature (1897)..(1897): n is a, c, g, or t
aacggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaaaaatggctactggacaggatcgagtggttgctctcgtggacatggactgtttttttgttcaagtggagcagcggcaaaatcctcatttgaggaataaaccttgtgcagttgtacagtacaaatcatggaagggtggtggaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtcctggcaaaactggcctgtggactaaacaagcccaaccgccaaaccctggtttcacatgggtcagtcccacagctcttcagccaaatgcccattcgcaaaatccgtagtcttggaggaaagctaggggcctctgtcattgagatcctagggatagaatacatgggtgaactgacccagttcactgaatcccagctccagagtcattttggggagaagaatgggtcttggctatatgccatgtgccgagggattgaacatgatccagttaaacccaggcaactacccaaaaccattggctgtagtaagaacttcccaggaaaaacagctcttgctactcgggaacaggtacaatggtggctgttgcaattagcccaggaactagaggagagactgactaaagaccgaaatgataatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagccctttagcgaaagntggtcttaggccgaaccgcttataatcttggttttcccccgaaaccggctccggtgggttccccttcaccggtccgggggcggtggtggggggcgagacctcatccggggttggccggaggcgttcacgtggggggggcccccttggtggtgtgggggagctgggtgccctttcgtcgccgcttgctctctct

SEQ ID NO: 373136 - DNA, 2305 bp, Homo sapiens
  misc_feature (499)..(499): n is a, c, g, or t
  misc_feature (726)..(726): n is a, c, g, or t
ggtgtgtagaggacattttcttaagcccttaagtacaaatttaagaggtaagtgcttcagccattagggttactggcttgttcatctttcccactgagtgtaaatatttagcttagggtttaaaatttgttatgtagctttttgcacttgtccatgtttatactactgtattattatttatttattttgagatggaagtctcactctgtcgcccaggctggagtgcagtggcgtgatcttagctcactgcaatctccgcctcccgggttcaagcgattctcctgcctcagcctctcgagtagctgggattacaggcatgtgccaccatgcccagctaatttttgtatttttagtagagacagggtttcatcatgttggccaggctggtctgaaactcctgacctcaagtgattgacccaccttggcctcccaaagtgctgggattacaggtgtgagccaccacaccccgcctatagtactgattcttattctccactcntgtgtgtgaaaagtcagctcttttggcttttctgttatggggaaacttgaattacacagggaacccaactgaagaaaattgaacctgggaggcggaggttgcagtgagccgagatttccactgcattccagcctgggcgatagagtaactctgtctcaaaaaaacccactagatcatctctagaacattgctactcccaagtatgatttgaggaacagcagcctcantatcaccagggaacttattagaaatagtctcagcctcaccactattcccacttaattgtaatctgatattaacaagatttcccaatgtgggtcaggtgtggtggctcatgcctgtaatcccacactttgggaggccaaggcaggtggatcacctgaggtcaggagttcaagaccagtctggccaacatggcgaaaccccatctctactaaaaatacaaaaattagccgggcgtggtggtgcacgcctgtaatcccagctactcaggaggctaaggcaggagaatcacttgaacccaggaggcagaggttggagtgagctgagatcgcgccaccgcactccagcctgggcaacagagcgagactccatctcaaacaaaaacaagaacaaaaacaaacataaagttggcacagaaaagggaccaagtttaaaaaagggttttaaatgtaatgagacttgcatagttaaaaaaaaaaaaaaaaaaaagaaaaacttctctttaggctgggtgcggttcctcatgcctataatcccagcatttagggaggctgaggtgagtggattgcaggagctcaggagttcgagaccagcctgggcaaggtggcaaaaccccgtctctactaaaaaaaattagctgggcttggtggcaggcgccgtgtaatcccaggtactcgggagactgaggcaggagaattgcttgaacctggaaggtggaggttgcagtgagttgagatcacaccaatgcactccagccagggtgagagtgagagactgtctcaaaaaaaaaaaaaacaaaagaaaaacttctctctagctctgtgacgggcagttcagataataccttcaccagatttacctgttttcagctgaagaatgtgagatgaagccttgaaaccctaaaagtgatatggtaactagggcaggtctttctgtacataaaagtgacttaataaacagtgaatttcatacaggtaaaccctattataccctcagttctaaccattggcctatctcttgcgttttgttctaatgtagaattagattgctacttgactagttcaggaactctgtttagatctgataagtcataatcaaatcttgccaggctgctgggattacaggcctgagccaccaggccagccccaacttctactttttattttatttataaattggggggggggttctatatttagtttgaagaggtggggaagatttgaaaaccactagatttaccaggaaatttttttcttcaaaaatattttctgcttttatgatacttgaatatctaataaaagacaatatttagccagtcacggtggctgatgcttgtaatcctaacactttgggaggctgaggtgggtggactactggagccctggagttcaaaaccggcctaagccacatggcaaaacagtctttacaaaaaatacaaagatggtggcttatgcctgtagtcgtacctactcaggaggctgaggttgggaggatcacctgaatctgggagtttggggctgcaataagccatgattgtgccgctgcactccagcctgggtgacagtctgagaccctgtctcaaaa

SEQ ID NO: 373137 - DNA, 1897 bp, Homo sapiens
  misc_feature (499)..(499): n is a, c, g, or t
  misc_feature (726)..(726): n is a, c, g, or t
ggtgtgtagaggacattttcttaagcccttaagtacaaatttaagaggtaagtgcttcagccattagggttactggcttgttcatctttcccactgagtgtaaatatttagcttagggtttaaaatttgttatgtagctttttgcacttgtccatgtttatactactgtattattatttatttattttgagatggaagtctcactctgtcgcccaggctggagtgcagtggcgtgatcttagctcactgcaatctccgcctcccgggttcaagcgattctcctgcctcagcctctcgagtagctgggattacaggcatgtgccaccatgcccagctaatttttgtatttttagtagagacagggtttcatcatgttggccaggctggtctgaaactcctgacctcaagtgattgacccaccttggcctcccaaagtgctgggattacaggtgtgagccaccacaccccgcctatagtactgattcttattctccactcntgtgtgtgaaaagtcagctcttttggcttttctgttatggggaaacttgaattacacagggaacccaactgaagaaaattgaacctgggaggcggaggttgcagtgagccgagatttccactgcattccagcctgggcgatagagtaactctgtctcaaaaaaacccactagatcatctctagaacattgctactcccaagtatgatttgaggaacagcagcctcantatcaccagggaacttattagaaatagtctcagcctcaccactattcccacttaattgtaatctgatattaacaagatttcccaatgtgggtcagcgtggtggctcacgcctgtaatcccagcagtctgggaggccaaggcaggtggatcacctgaggtcaggagtttgagaccagtctggccaacatggtgaaaccccatctctactaaaattacaaaaattagccggtgtgctggcgcatgccgtgtaatcccaggtactcgggagactgaggcaggagaattgcttgaacctggaaggtggaggttgcagtgagttgagatcacaccaatgcactccagccagggtgagagtgagagactgtctcaaaaaaaaaaaaaacaaaagaaaaacttctctctagctctgtgacgggcagttcagataataccttcaccagatttacctgttttcagctgaagaatgtgagatgaagccttgaaaccctaaaagtgatatggtaactagggcaggtctttctgtacataaaagtgacttaataaacagtgaatttcatacaggtaaaccctattataccctcagttctaaccattggcctatctcttgcgttttgttctaatgtagaattagattgctacttgactagttcaggaactctgtttagatctgataagtcataatcaaatcttgccaggctgctgggattacaggcctgagccaccaggccagccccaacttctactttttattttatttataaattggggggggggttctatatttagtttgaagaggtggggaagatttgaaaaccactagatttaccaggaaatttttttcttcaaaaatattttctgcttttatgatacttgaatatctaataaaagacaatatttagccagtcacggtggctgatgcttgtaatcctaacactttgggaggctgaggtgggtggactactggagccctggagttcaaaaccggcctaagccacatggcaaaacagtctttacaaaaaatacaaagatggtggcttatgcctgtagtcgtacctactcaggaggctgaggttgggaggatcacctgaatctgggagtttggggctgcaataagccatgattgtgccgctgcactccagcctgggtgacagtctgagaccctgtctcaaaa

SEQ ID NO: 373138 - DNA, 1268 bp, Homo sapiens
  misc_feature (499)..(499): n is a, c, g, or t
ggtgtgtagaggacattttcttaagcccttaagtacaaatttaagaggtaagtgcttcagccattagggttactggcttgttcatctttcccactgagtgtaaatatttagcttagggtttaaaatttgttatgtagctttttgcacttgtccatgtttatactactgtattattatttatttattttgagatggaagtctcactctgtcgcccaggctggagtgcagtggcgtgatcttagctcactgcaatctccgcctcccgggttcaagcgattctcctgcctcagcctctcgagtagctgggattacaggcatgtgccaccatgcccagctaatttttgtatttttagtagagacagggtttcatcatgttggccaggctggtctgaaactcctgacctcaagtgattgacccaccttggcctcccaaagtgctgggattacaggtgtgagccaccacaccccgcctatagtactgattcttattctccactcntgtgtgtgaaaagtcagctcttttggcttttctgttatggggaaacttgaattacacagggaacccaactgaagaaattgaacctgggaggcagaggttgcagtgagccgagatttccactgcattccagcctgggcgatagagtaactctgtctcaaaaaaacccactagatcatctctagaacattgctactcccaagtatgatttgaggaacagcagcctcagtatcaccagggaacttattagaaatagtctcagcctcaccactattcccacttaattgtaatctgatattaacaagatttcccaatgtgggtcaggtgtggtggctcatgcctgtaatcccacactttgggaggccaaggtgggcggatcacttgaggctgggagtttgagaccaggctggccaacatggggaaaacccatctctacaaaaaataacaaaaattaggtgtgtgtggtgacgcatgcgtgtaatcccagctacttaggaggctgaggcaggagaatcacttgaatctgggaggcagaggttgtagtgagctgagattgtgccactgcactccagtctgggcaacagagtgacactgttacacgctgaagcaatgtgacgatgaagccttgaaaacctaacaagtgatatggtaactagggcaggtctttctgtacataaaagtgacttcactaaacagtgaattccatacaggtcaaccctattataccctcagttctaacattggctatctcttgcgttggtcttatgtagaa

SEQ ID NO: 373139 - DNA, 1004 bp, Homo sapiens
ctgtaatcccagcactttgggaggccgaggcgggcggatcacgaggtcaggagatcgagaccatcctggctaacacggtgaaaccccgtctctactaaaaatacaaaaaattagccgggcggggtggcacgcgcctgtagtcccagccactttgggaggccaaggcaggtggaccacgtgaagtcaggagttcaagacaagcatggccaacatggcgaaaccctgtatctactaaaaatacaaaaattagccgggcatggtggtgggtgcgtgtaatcccagctagttgggaggctgaggcaggagaatcacttgaacctgggaggcagaggttgcagtgagccgagatttccactgcattccagcctgggcgatagagtaactctgtctcaaaaaaacccactagatcatctctagaacattgctactcccaagtatgatttgaggaacagcagcctcagtatcaccagggaacttattagaaatagtctcagcctcaccactattcccacttaattgtaatctgatattaacaagatttcccaatgtgggtcaggtgtggtggctcatgcctgtaatcccacactttgggaggccaaggtgggcggatcacttgaggctgggagtttgagaccaggctggccaacatggggaaaacccatctctacaaaaaataacaaaaattaggtgtgtgtggtgacgcatgcgtgtaatcccagctacttaggaggctgaggcaggagaatcacttgaatctgggaggcagaggttgtagtgagctgagattgtgccactgcactccagtctgggcaacagagtgacactgttacacgctgaagcaatgtgacgatgaagccttgaaaacctaacaagtgatatggtaactagggcaggtctttctgtacataaaagtgacttcactaaacagtgaattccatacaggtcaaccctattataccctcagttctaacattggctatctcttgcgttggtcttatgtagaa

SEQ ID NO: 373140 - DNA, 740 bp, Homo sapiens
ttatgtgacggagtttctctcatcgccccggctggaatgcaatggcacgatctcggctcactgcaacctccgcctcccgggttcaagcgattctcctgcatcagcctcctgagtagctgggattataggcatgcaccatcacgcctggctaatttttgtatttttagtagagatggggtttcgccacgttggccaggctggtcttgaactcttgatctcaagtgatccacccgccctggcctcccaaggtgctgggattacaggcctgagccaccaggccagccccaacttctactttttattttatttataaattggggggggggttctatatttagtttgaagaggtggggaagatttgaaaaccactagatttaccaggaaatttttttcttcaaaaatattttctgcttttatgatacttgaatatctaataaaagacaatatttagccagtcacggtggctgatgcttgtaatcctaacactttgggaggctgaggtgggtggactactggagccctggagttcaaaaccggcctaagccacatggcaaaacagtctttacaaaaaatacaaagatggtggcttatgcctgtagtcgtacctactcaggaggctgaggttgggaggatcacctgaatctgggagtttggggctgcaataagccatgattgtgccgctgcactccagcctgggtgacagtctgagaccctgtctcaaaaaaaaaaaaaaaaaaaaa

SEQ ID NO: 373141 - DNA, 2328 bp, Homo sapiens
aacggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaaaaatggctactggacaggatcgagtggttgctctcgtggacatggactgtttttttgttcaagtggagcagcggcaaaatcctcatttgaggaataaaccttgtgcagttgtacagtacaaatcatggaagggtggtggaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtcctggcaaaactggcctgtggactaaacaagcccaaccgccaaaccctggtttcacatgggtcagtcccacagctcttcagccaaatgcccattcgcaaaatccgtagtcttggaggaaagctaggggcctctgtcattgagatcctagggatagaatacatgggtgaactgacccagttcactgaatcccagctccagagtcattttggggagaagaatgggtcttggctatatgccatgtgccgagggattgaacatgatccagttaaacccaggcaactacccaaaaccattggctgtagtaagaacttcccaggaaaaacagctcttgctactcgggaacaggtacaatggtggctgttgcaattagcccaggaactagaggagagactgactaaagaccgaaatgataatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatgacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgc

SEQ ID NO: 373142 - DNA, 4643 bp, Homo sapiens
aacggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaaaaatggctactggacaggatcgagtggttgctctcgtggacatggactgtttttttgttcaagtggagcagcggcaaaatcctcatttgaggaataaaccttgtgcagttgtacagtacaaatcatggaagggtggtggaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtcctggcaaaactggcctgtggactaaacaagcccaaccgccaaaccctggtttcacatgggtcagtcccacagctcttcagccaaatgcccattcgcaaaatccgtagtcttggaggaaagctaggggcctctgtcattgagatcctagggatagaatacatgggtgaactgacccagttcactgaatcccagctccagagtcattttggggagaagaatgggtcttggctatatgccatgtgccgagggattgaacatgatccagttaaacccaggcaactacccaaaaccattggctgtagtaagaacttcccaggaaaaacagctcttgctactcgggaacaggtacaatggtggctgttgcaattagcccaggaactagaggagagactgactaaagaccgaaatgataatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtgggccttggagtctaagagacgtggttgcaaacttagctctggttattgcaatgagggccttgaacaagtcattttcttcacattctcatctgtaaaatggagataataccttacagattattgcagattaataacaatgtattcaaattatgtaactcggccgggtacaatggctcacgcctgtaatcctaacactttgggaggccgaggcagacagatcacctgaggtcaggagtttgagaccagcctggccaacatggcaaaaccatctctactaaaaatagaaaaattagccaggcacgttccaggcacctgtgatcccagctacttagaggctgaggcagaagaattgctttaaccttggaggcggaggttgcattgagctgagatcatgctagtgcgctccagcctgggcaacagagcgagacttcatctcagaaaataaaaaataggggccaggcacagtggctcatacctgtaatgccagcactttgggaggccaaggcgggcagatcacgaggtcaggagtttcagaccaatatggtgaaaccccatctctactaaaattacaaaaaaaattatccaggcgtggtggtgcacgcctgtaatcccagctactcaggaggctaaggcaggagaatcacttgaacccaggaggcagaggttggagtgagctgagatcgcgccaccgcactccagcctgggcaacagagcgagactccatctcaaacaaaaacaagaacaaaaacaaacataaagttggcacagaaaagggaccaagtttaaaaaagggttttaaatgtaatgagacttgcatagttaaaaaaaaaaaaaaaaaaaagaaaaacttctctttaggctgggtgcggttcctcatgcctataatcccagcatttagggaggctgaggtgagtggattgcaggagctcaggagttcgagaccagcctgggcaaggtggcaaaaccccgtctctactaaaaaaaattagctgggcttggtggcaggcgccgtgtaatcccaggtactcgggagactgaggcaggagaattgcttgaacctggaaggtggaggttgcagtgagttgagatcacaccaatgcactccagccagggtgagagtgagagactgtctcaaaaaaaaaaaaaacaaaagaaaaacttctctctagctctgtgacgggcagttcagataataccttcaccagatttacctgttttcagctgaagaatgtgagatgaagccttgaaaccctaaaagtgatatggtaactagggcaggtctttctgtacataaaagtgacttaataaacagtgaatttcatacaggtaaaccctattataccctcagttctaaccattggcctatctcttgcgttttgttctaatgtagaattagattgctacttgactagttcaggaactctgtttagatctgataagtcataatcaaatcttgccaggctgctgggattacaggcctgagccaccaggccagccccaacttctactttttattttatttataaattggggggggggttctatatttagtttgaagaggtggggaagatttgaaaaccactagatttaccaggaaatttttttcttcaaaaatattttctgcttttatgatacttgaatatctaataaaagacaatatttagccagtcacggtggctgatgcttgtaatcctaacactttgggaggctgaggtgggtggactactggagccctggagttcaaaaccggcctaagccacatggcaaaacagtctttacaaaaaatacaaagatggtggcttatgcctgtagtcgtacctactcaggaggctgaggttgggaggatcacctgaatctgggagtttggggctgcaataagccatgattgtgccgctgcactccagcctgggtgacagtctgagaccctgtctcaaaa

SEQ ID NO: 373143 - DNA, 3563 bp, Homo sapiens
  misc_feature (3544)..(3544): n is a, c, g, or t
aacggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaaaaatggctactggacaggatcgagtggttgctctcgtggacatggactgtttttttgttcaagtggagcagcggcaaaatcctcatttgaggaataaaccttgtgcagttgtacagtacaaatcatggaagggtggtggaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtcctggcaaaactggcctgtggactaaacaagcccaaccgccaaaccctggtttcacatgggtcagtcccacagctcttcagccaaatgcccattcgcaaaatccgtagtcttggaggaaagctaggggcctctgtcattgagatcctagggatagaatacatgggtgaactgacccagttcactgaatcccagctccagagtcattttggggagaagaatgggtcttggctatatgccatgtgccgagggattgaacatgatccagttaaacccaggcaactacccaaaaccattggctgtagtaagaacttcccaggaaaaacagctcttgctactcgggaacaggtacaatggtggctgttgcaattagcccaggaactagaggagagactgactaaagaccgaaatgataatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtgggccttggagtctaagagacgtggttgcaaacttagctctggttattgcaatgagggccttgaacaagtcattttcttcacattctcatctgtaaaatggagataataccttacagattattgcagattaataacaatgtattcaaattatgtaactcggccgggtacaatggctcacgcctgtaatcctaacactttgggaggccgaggcagacagatcacctgaggtcaggagtttgagaccagcctggccaacatggcaaaaccatctctactaaaaatagaaaaattagccaggcacgttccaggcacctgtgatcccagctacttagaggctgaggcagaagaattgctttaaccttggaggcggaggttgcattgagctgagatcatgctagtgcgctccagcctgggcaacagagcgagacttcatctcagaaaataaaaaataggggccaggcacagtggctcatacctgtaatgccagcactttgggaggccaaggcgggcagatcacgaggtcaggagtttcagaccaatatggtgaaaccccatctctactaaaattacaaaaaaaattatccaggcgtggtggtgcacgcctgtaatcccagctactcaggaggctaaggcaggagaatcacttgaacccaggaggcagaggttggagtgagctgagatcgcgccaccgcactccagcctgggcaacagagcgagactccatctcaaacaaaaacaagaacaaaaacaaacataaagttggcacagaaaagggaccaagtttaaaaaagggttttaaatgtaatgagacttgcatagttaaaaaaaaaaaagggnccgttggtacccgacctga

SEQ ID NO: 373144 - DNA, 3451 bp, Homo sapiens
ttatattttatctttactctttgcagaactcagtttacctttattcttgacttttaaactactgtttccaaaccattgtcaccctggttcttttaatttcctctcctgcagttcagtacctagaattcagatgctcctcataactttatttctggtctccatcctttccacccacagaatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtgggccttggagtctaagagacgtggttgcaaacttagctctggttattgcaatgagggccttgaacaagtcattttcttcacattctcatctgtaaaatggagataataccttacagattattgcagattaataacaatgtattcaaattatgtaactcggccgggtacaatggctcacgcctgtaatcctaacactttgggaggccgaggcagacagatcacctgaggtcaggagtttgagaccagcctggccaacatggcaaaaccatctctactaaaaatagaaaaattagccaggcacgttccaggcacctgtgatcccagctacttagaggctgaggcagaagaattgctttaaccttggaggcggaggttgcattgagctgagatcatgctagtgcgctccagcctgggcaacagagcgagacttcatctcagaaaataaaaaataggggccaggcacagtggctcatacctgtaatgccagcactttgggaggccaaggcgggcagatcacgaggtcaggagtttcagaccaatatggtgaaaccccatctctactaaaattacaaaaaaaattatccaggcgtggtggtgcacgcctgtaatcccagctactcaggaggctaaggcaggagaatcacttgaacccaggaggcagaggttggagtgagctgagatcgcgccaccgcactccagcctgggcaacagagcgagactccatctcaaacaaaaacaagaacaaaaacaaacataaagttggcacagaaaagggaccaagtttaaaaaagggttttaaatgtaatgagacttgcatagttaaaaaaaaaaaaaaaaaaaagaaaaacttctctttaggctgggtgcggttcctcatgcctataatcccagcatttagggaggctgaggtgagtggattgcaggagctcaggagttcgagaccagcctgggcaaggtggcaaaaccccgtctctactaaaaaaaattagctgggcttggtggcaggcgccgtgtaatcccaggtactcgggagactgaggcaggagaattgcttgaacctggaaggtggaggttgcagtgagttgagatcacaccaatgcactccagccagggtgagagtgagagactgtctcaaaaaaaaaaaaaacaaaagaaaaacttctctctagctctgtgacgggcagttcagataataccttcaccagatttacctgttttcagctgaagaatgtgagatgaagccttgaaaccctaaaagtgatatggtaactagggcaggtctttctgtacataaaagtgacttaataaacagtgaatttcatacaggtaaaccctattataccctcagttctaaccattggcctatctcttgcgttttgttctaatgtagaattagattgctacttgactagttcaggaactctgtttagatctgataagtcataatcaaatcttgccaggctgctgggattacaggcctgagccaccaggccagccccaacttctactttttattttatttataaattggggggggggttctatatttagtttgaagaggtggggaagatttgaaaaccactagatttaccaggaaatttttttcttcaaaaatattttctgcttttatgatacttgaatatctaataaaagacaatatttagccagtcacggtggctgatgcttgtaatcctaacactttgggaggctgaggtgggtggactactggagccctggagttcaaaaccggcctaagccacatggcaaaacagtctttacaaaaaatacaaagatggtggcttatgcctgtagtcgtacctactcaggaggctgaggttgggaggatcacctgaatctgggagtttggggctgcaataagccatgattgtgccgctgcactccagcctgggtgacagtctgagaccctgtctcaaaa

SEQ ID NO: 373145 - DNA, 945 bp, Homo sapiens
aacggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaaaaatggctactggacaggatcgagtggttgctctcgtggacatggactgtttttttgttcaagtggagcagcggcaaaatcctcatttgaggaataaaccttgtgcagttgtacagtacaaatcatggaagggtggtggaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaaggtacttccatagcatcatactgcttctgcttcctgcctttggaacctgctttgcttggtcatgctgattctccttggaataattgaaaggaaacttaaactacagcctgaatgaatcacaaggactcacatggaaggatatacaaattttcttatctttc

SEQ ID NO: 373146 - DNA, 435 bp, Homo sapiens
cacagggagtttcttagggcaatagaactaatagagtattctgtgtgatactctaataatgaatacatgacactgtgtcttcatcaaaacccacagaactttacagtacaaagaatgaactctaataatagacaaattgaaaatatcatttaggaggtcaggggcaggggatttcaacatgaaatgcagaatgtgacaaaagagtctaatgatacagtatcactaaaaggtaagggggaaaaggtcttgacctaagtgactttgaaaatgagtaaagattgtaagactgaaggcaaagcaactgtatactgacgttgtactctagttgataaagttctttcccatgggcataagggttaacaactctgaaaccactatacatgtatcctggaattgaacagttaagtaaatggatagcagattgtgggagccagg

SEQ ID NO: 373147 - DNA, 425 bp, Homo sapiens
  misc_feature (391)..(391): n is a, c, g, or t
ttacttaggaatatttttaaatttattacattactgtaaactttctgacaaattcaaaattaaataattccaacttgttcacggtaagcacaacagtgatttgtcaaaggcttcttgctttttccaggatccatcatagatacttgtttctgcctcttctgtcctcttaatatcctggtagacacagagactccatagcacccataccactgcccactctctcacccctccagcacctgaaactcatttgaaagctttcagctggggggtgggtggctcacgcctgtaaatcccagcactttcggagggccaagggggtgggataacttgagggtcagggagtttcgaggaccagcctgggccaacctgaacaaaaccctatctctacttnaaaaattaccaaaatttagccgagcatggtggca

SEQ ID NO: 373148 - DNA, 458 bp, Homo sapiens
tcctggccaaaatgacgaaaccctgtctgtactaaaaatacaaaaattagccgggcatggtggtgcatacctataatcccagctattcaggaggctgaggcatgaaacgtggaggttgtagtgagccgagatcgcaccactgcactccagcctgggcgagagagtgagaccccatctcacacacaaaaaaaggggagattatttggggtggagtgggcctcaaaccctggggaaacatttgtgctaagttccatgggcagctttggggatttgctccacaaggactcccgagagatcagtgtccgcagggtgacaccggtggctgggtgaccaggagaggtagaggggagatggggcctttgctgagaccctgtggaggtgatgaggttggaggagaggccatgtggaggagaccagctaagagcaaggaggggacggcctcagggaccacactgtct

SEQ ID NO: 373149 - DNA, 1427 bp, Homo sapiens
  misc_feature (612)..(612): n is a, c, g, or t
  misc_feature (740)..(740): n is a, c, g, or t
aagtagttgcgggagggcgcggagcacgccgggaagctcgcgggtcggcaccgggacagctcccgggcgccgtggaatgcacacgtcccgcacccggaccttccggtcagcttcccggctcgctgtctgatgcccgcggtagccaatgagctagtggtgtttgtcctgctccgtccccgccctccaggggaaccaatcccattgcaggagaggcaggacgcgcaaaggcccgaaagaggagctgggcggggtggggggaaggcggaggcagtctagtaatgtaaagctccgctgagagggagagtgctgaagaaggggacagcctctgtacctgcggcgcggcccgaggggcggacgcgagcggactgacgcgctggaggctgtttatagcgctgtcaggacagcgcggggagtggaggcagaggcctgagaggctccccgggaggatagaggcatcatgatggatggatcatgaattccaaagggcatcaaattagccaacttaaaaaacggaatactctcgcggcaagatcggatcctgatagaccttcccataatataaagccgcgataaacggtgcattcctgcaaaatcatgatcaaacatctgaancacctctgatcggctattaggctaagctgccacagataacgggactgaatattgatgaattacaaccaagatactgagcggactgatcaaaatccattgtctgctggattgaagatctaggagcctanatcaaacatagattcttgtggcgaaaaaggagaccagctcagaaaaacgaatcgaacatgcctcaatagctcgaaagggacatcaaatcttttaaagacaaagttacctcgaatcgccgggagccagtattcaaagtagtgcttaggcgggggggaaatgctgcttaaatggcctggattggcatagccataaatggcaggggacgctttataatattcatatgcatcacattaattttttaaaacgacaccccaaatcaaaaccaaaatagaaacatcagcattttagaaagggacagtggcatcaaccggacaatttagagggagccctaatttaaattcccccccgcggggggagagccaatggaccataacacacaccttgtatgaaagccccctattacgagagacagaggcgatccaaaattgagagaccccctgggagggacctcaaccctctatgtgacaaccccgacggatggctccaaaaggttgtggtgaccaccgtgtgagttcctagaagaatttaagtaattcccagaaagatttaatgaagcccccgaacatgtcaatgaaagcccaacacatccagaagaacaccaataaaaacccaagccaaaagtccccacccaaaccaaaacaacaacacacaagaaaaaacacacaaaacagaaacgaacccaccaa

SEQ ID NO: 373150 - DNA, 770 bp, Homo sapiens
ccccctcagccctgctgagctagaggtggagtcctcagagggctgagtagggagagggctgggcgggggcagtggaggagcctgaggtccattcacatgtggagaccccaggggtcctgaggctccagctgctgtaagtcacaagtgggccaagtccccactaatcagcctctcctttggccatcctcagaccgcatggtgccgagcgcccacaacaggctcatggaacagctggccctcctgtgcaccacgcagtccaaggcctctgcttgtgcccggaaggtgcctgccgacactccccaggacaccaaagaggcagattcaggaagcaggtgggacttgtagccaggcccggctcctgtggtcctttagaatggccccatggttttgtagcactgactgggcctaccaagggcggggcactccatgtgcattttctcagtcactctcaagcatctgatcaggcagtcgctccagtcatccccattttagagatggggaaaccaaggctcagagaggttgactctctctggccataaatggcagggctgggactcaagccctcaagtacctgctctttccccaaacccaacgggaaccctcctttcaatgggaggccatgaggcctccctgagagtaggaaggttatcatgtgaccctgcccctctggccacagctgattggtccagctctgggcatgtgaccccagctgcgggatttttcaatctctgtgtctctgtgtaggggtggaagggcaacagccacctgtc

SEQ ID NO: 373151 - DNA, 136 bp, Homo sapiens
ctccagccacagctcctctgacagtgaggaggaggaggaggaagagatggcagctctgggagacgcagagggggcatctccttcctccctggggctacggtaaccacccaggggcctctcgccacctgcagatgtc

SEQ ID NO: 373152 - DNA, 2678 bp, Homo sapiens
aagtagttgcgggagggcgcggagcacgccgggaagctcgcgggtcggcaccgggacagctcccgggcgccgtggaatgcacacgtcccgcacccggaccttccggtcagcttcccggctcgctgtctgatgcccgcggtagccaatgagctagtggtgtttgtcctgctccgtccccgccctccaggggaaccaatcccattgcaggagaggcaggacgcgcaaaggcccgaaagaggagctgggcggggtggggggaaggcggaggcagtctagtaatgtaaagctccgctgagagggagagtgctgaagaaggggacagcctctgtacctgcggcgcggcccgaggggcggacgcgagcggactgacgcgctggaggctgtttatagcgctgtcaggacagcgcggggagtggaggcagaggcctgagagctccccggattatggtgcactgagaaggcatctggaagcctgggccctcatggcatccaacgataaaggcatggcaccctcgctgggctctccctgggcctcccagatggggccctgggatgccatcctcaaggctgtcaaagaccagctcccgtctctggactcagactcccctttgtcggactatggggaagaggagctgttcatcttccagcgaaaccaaacctccctgattccagacctgtcggaggagctggctgaagatcctgccgatggcgacaagtccagggcctgggtcgctgcagctgaagagtcccttcccgagccagttctggtgcctgcagaattggccacagaacctgggtgcagacagaacacaaggacaaaggatgcatcctctcaggaaggaagagaccctggcaggccttttgaaagctctggtgaggtcagcgctcttcttgggatggccgaggagccccccaggtggctggaaggcgaccttggaagcctgtctttcaacaccaaaggatcccagggtcctccctgggacccacaggccgaagccactctctcctgccatgaaggagacccaaaggcagagcccctcagcactgcctcacaagaatctgtgaaccgccgggccctccgacaggagagaaggaagatgatagagacggacatcctccagaaagtcacccgggatgcctgcggcccgaccagcagtgacaaaggtggggtgaaggaggcgccctgccacgctgcggagtcagctcccagatccaaaatgcccctcgtggagcctccggagggaccaccagtgctctcgctccagcaacttgaagcgtgggatttggatgacatccttcagagtctggcgggacaagaagacaaccagggaaatcgtgcacctggaactgtgtggtgggcagctgaccaccgccaagttcaagaccgcatggtgccgagcgcccacaacaggctcatggaacagctggccctcctgtgcaccacgcagtccaaggcctctgcttgtgcccggaaggtgcctgccgacactccccaggacaccaaagaggcagattcaggaagcagatgtgcctcaaggaagcagggctcccaggctgggccaggcccgcagctggcccagggcatgaggcttaacgcagagtcccccaccatctttattgacctgcggcagatggagctaccagaccacctgtccccagaaagctccagccacagctcctctgacagtgaggaggaggaggaggaagagatggcagctctgggagacgcagagggggcatctccttcctccctggggctacggacctgtaccgggaaaagccagcttctccagcagctcagggcctttcagaaggggacagcccagcccgagctgcctgccagcaaggggcccgcgggtgggagggctcaggcccctgaagacacagctggatcacgaactgggaggaagcaacacatgaagctctgtgccaaggggcagagcgcccaggctcgactcccaagaggcaggcccagagccctgggggatgttcctgagccaggggcagccagggaggccctgatgcctcctctggagcaactatagctgcctcaggatgtgtcctgctgtctgccccgtgggaagagcagagaaatcatcaccaccttgggccccacggtgccacgggctcaggcagcacagtagggcgccgggcctttgggacagtgtcccagcttcccctggggttcacccctggctgccaggccactgaggatgggcaggggtctcttctcatcaagccttgtaccaggcaaaagacaggccctgcttggccgtggtcactggccgccaagatcagggctacagatgtctgctctctggaccccacgtgatctggccactggggacccccacccgaccccactcccaatgatgaggggcattttcattgcaagtcaaaggcaagacaggcttccataaagtcccaggaggtccctcctgtagggcacaaggccaggctgcctcccagcccccaggccctctcccacctacagagaccctcccctgccccctccactccggggcctgtgccgccagaaccgggctctgcccccatacgctgccctcgcagcctggcggcctccgctgtggctgcctagctgtcaagagcaaaggctttttttttcttcaaccccattttcttccatttctcccacctttttaatgccagtaacctca

SEQ ID NO: 373153 - DNA, 215 bp, Homo sapiens
tggagagtggtgcacatgctgtggaagacagttgggtggcttctcagttgaatgtgaaattgtcatatgactcaaatattctaccctaggtatatactcccagataactgaaaacaggtattcaaacaaacacttgtatatgaatgtttatagcaacccttatttacgttagctaaaatgtagaaacaacccaaatgtccatcagctgatgaatg

SEQ ID NO: 373154 - DNA, 1701 bp, Homo sapiens
acgaggaagaaggaaaacgatttcaagagctgcacttaagcatctagaattttctgcgtcacacctcttgagagaagagactggctccaggtctgactcagtccactacaagctagacggtcttcttaaagcaccaacattacttgagtctttggataaaattgagaaaagagtctacaagtattgtggactctacaggaggcaggaggctgacaactggcagtaaagacaaagatgtcaggcctgcggcccggcactcaagtggaccctgagattgagctttttgtaaaggctggaagtgatggagagagtattggaaactgtcccttttgccaacgccttttcatgatcctctggcttaaaggagttaaatttaatgtgacaactgttgacatgaccagaaagcctgaagaactaaaggacttagccccaggtaccaatcctccgttcctggtgtataacaaggagttgaaaacagacttcattaaaattgaggagtttttagaacaaaccctggctcctccaaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttaggagagctcttacaggagaaaaggctatatttgtgatcagattttacttattgacatattagaaaggtttttgcaaataagaatatgaaaaatactgtttcttctatccaactctcttatgaaaaggaactctgtattttctattagccataaataatctgtccactgtattttacaggtcttcatacttttacttaattttctttatctgtatggcaaaccactgcaatcctgaatgacatggaaagcatcacaatcttttgccctttgcttgaattcctggaatgcatacatataagctaaacagatgtctgcagttataaatgtcataagtagaggtacaatctcaccctgctccttagaaacatttccatataaatcgctaaaataatttcacatttttgttagtttaatatatacatgagtttatttctgatataaataataaatacagagagtgagcatatcagagaggcaaattcttaaagaatgatttttaaaatcagctctaggaagagctcaagatcaattggtcatagaacagcatttgacgcctagaactatgaccacctcatggtcagagatgagaatgtagcctttgtgaccagattatattatttttaaatgaagaagcactcattaaataaaacataattttaaaaaacaatataagaaacaaagtcaactgaatcttttattcatagaaatgaaaaggaaaataaaa

SEQ ID NO: 373155 - DNA, 1636 bp, Homo sapiens
acgaggaagaaggaaaacgatttcaagagctgcacttaagcatctagaattttctgcgtcacacctcttgagagaagagactggctccaggtctgactcagtccactacaagctagacggtcttcttaaagcaccaacattacttgagtctttggataaaattgagaaaagagtctacaagtattgtggactctacaggaggcaggaggctgacaactggcagtaaagacaaagatgtcaggcctgcggcccggcactcaagtggaccctgagattgagctttttgtaaaggctggaagtgatggagagagtattggaaactgtcccttttgccaacgccttttcatgatcctctggcttaaaggagttaaatttaatgtgacaactgttgacatgaccagaaagcctgaagaactaaaggacttagccccaggtaccaatcctccgttcctggtgtataacaaggagttgaaaacagacttcattaaaattgaggagtttttagaacaaaccctggctcctccaaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttaggagagctcttacaggagaaaaggctatatttgtgatcagattttacttattgacatattagaaaggtttttgcaaataagaatatgaaaaatactgtttcttctatccaactctcttatgaaaaggaactctgtattttctattagccataaataatctgtccactgtattttacaggtcttcatacttttacttaattttctttatctgtatggcaaaccactgcaatcctgaatgacatggaaagcatcacaatcttttgccctttgcttgaattcctggaatgcatacatataagctaaacagatgtctgcagttataaatgtcataagtagaggtacaatctcaccctgctccttagaaacatttccatataaatcgctaaaataatttcacatttttgttagtttaatatatacatgagtttatttctgatataaataataaatacagagagtgagcatatcagagaggcaaattcttaaagaatgatttttaaaatcagctctaggaagagctcaagatcaattggtcatagaacagcatttgacgcctagaactatgaccacctcatggtcagagatgagaatgtagcctttgtgaccagattatattatttttaaatgaagaagcactcattaaataaaacataatttta

SEQ ID NO: 373156 - DNA, 2233 bp, Homo sapiens
tctggatgactacttaaacattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttaggagagctcttacaggagaaaaggctatatttgtgatcagattttacttattgacatattagaaaggtttttgcaaataagaatatgaaaaatactgtttcttctatccaactctcttatgaaaaggaactctgtattttctattagccataaataatctgtccactgtattttacaggtcttcatacttttacttaattttctttatctgtatggcaaaccactgcaatcctgaatgacatggaaagcatcacaatcttttgccctttgcttgaattcctggaatgcatacatataagctaaacagatgtctgcagttataaatgtcataagtagaggtacaatctcaccctgctccttagaaacatttccatataaatcgctaaaataatttcacatttttgttagtttaatatatacatgagtttatttctgatataaataataaatacagagagtgagcatatcagagaggcaaattcttaaagaatgatttttaaaatcagctctaggaagagctcaagatcaattggtcatagaacagcatttgacgcctagaactatgaccacctcatggtcagagatgagaatgtagcctttgtgaccagattatattatttttaaatgaagaagcactcattaaataaaacataattttaaaaaacaatataagaaacaaagtcaactgaatcttttattcatagaaatgaaaaggaaaataaaaactgtggctgaccaaaaggtcttcttgttgtccataaaaggataaggtaaacagtccttagataattacaaaactttctacaaaagttaaaatgttacattactatacgtattcagattcacttgttaaagtactcttaaatcattcaaatctggaaacaaaagctgaacttaactcttgctccctcaaaagagaaacacaagcataagtgcagcttcaaaaaaggaaaatattttaggctttggtggaagggtggagtttagataaaatttaaatgaagtagcgttttaataggttcaaagaaaagtaaggcaatgagcaaactcaaagtactgtccttgaaaaccatagagtcaagataaatgtatagtgtatggttaggtggcagagaaatgcaatcatgttgataatctttgagatacatcctgtcatcagtatatttcagaatacatgcaatgcactagcaagttacaattgatagaatacatttgaaatgttaaatgaaataagccaggcacagaaagacaaacaccacatgatctcactcatatgtggaattttaaaaagttgatctcactcatatgtggaattttaaaaagttgatctcacacaagtagagggtagaatcgtggttaccaggggctagggagagaaagaaggcagaggcactgaaagatgttggtcaatgggtataaagttacacctaggaagaataaattttggtattcaccacagtagggtgactatagcaaataataatgtagcatgtatttcaagatagctagaaaagcaggtttttaaatgtcaccacaaagaaataacaaatgtttatagtggtggatatggtaattacgcctatttgatcattatactgtgtgtacatgcattgaaacaccacattgtatcccatatatatgtacaattatgtgcccattatacatttaaaaaataaattttaaaaaccttcaattaactcttggtttaaaagaaaaatataaaccaaaactacatgatctctaaaacaaataatgatgatgtaaacacttcatatcagaatccatgggataaatataaagcagtgatcagaggaaattttataactaaacactgctattagtaaaaataaaagattgaaaataaattgatt

SEQ ID NO: 373157 - DNA, 2848 bp, Homo sapiens
acgaggaagaaggaaaacgatttcaagagctgcacttaagcatctagaattttctgcgtcacacctcttgagagaagagactggctccaggtctgactcagtccactacaagctagacggtcttcttaaagcaccaacattacttgagtctttggataaaattgagaaaagagtctacaagtattgtggactctacaggaggcaggaggctgacaactggcagtaaagacaaagatgtcaggcctgcggcccggcactcaagtggaccctgagattgagctttttgtaaaggctggaagtgatggagagagtattggaaactgtcccttttgccaacgccttttcatgatcctctggcttaaaggagttaaatttaatgtgacaactgttgacatgaccagaaagcctgaagaactaaaggacttagccccaggtaccaatcctccgttcctggtgtataacaaggagttgaaaacagacttcattaaaattgaggagtttttagaacaaaccctggctcctccaaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttaggagagctcttacaggagaaaaggctatatttgtgatcagattttacttattgacatattagaaaggtttttgcaaataagaatatgaaaaatactgtttcttctatccaactctcttatgaaaaggaactctgtattttctattagccataaataatctgtccactgtattttacaggtcttcatacttttacttaattttctttatctgtatggcaaaccactgcaatcctgaatgacatggaaagcatcacaatcttttgccctttgcttgaattcctggaatgcatacatataagctaaacagatgtctgcagttataaatgtcataagtagaggtacaatctcaccctgctccttagaaacatttccatataaatcgctaaaataatttcacatttttgttagtttaatatatacatgagtttatttctgatataaataataaatacagagagtgagcatatcagagaggcaaattcttaaagaatgatttttaaaatcagctctaggaagagctcaagatcaattggtcatagaacagcatttgacgcctagaactatgaccacctcatggtcagagatgagaatgtagcctttgtgaccagattatattatttttaaatgaagaagcactcattaaataaaacataattttaaaaaacaatataagaaacaaagtcaactgaatcttttattcatagaaatgaaaaggaaaataaaaactgtggctgaccaaaaggtcttcttgttgtccataaaaggataaggtaaacagtccttagataattacaaaactttctacaaaagttaaaatgttacattactatacgtattcagattcacttgttaaagtactcttaaatcattcaaatctggaaacaaaagctgaacttaactcttgctccctcaaaagagaaacacaagcataagtgcagcttcaaaaaaggaaaatattttaggctttggtggaagggtggagtttagataaaatttaaatgaagtagcgttttaataggttcaaagaaaagtaaggcaatgagcaaactcaaagtactgtccttgaaaaccatagagtcaagataaatgtatagtgtatggttaggtggcagagaaatgcaatcatgttgataatctttgagatacatcctgtcatcagtatatttcagaatacatgcaatgcactagcaagttacaattgatagaatacatttgaaatgttaaatgaaataagccaggcacagaaagacaaacaccacatgatctcactcatatgtggaattttaaaaagttgatctcactcatatgtggaattttaaaaagttgatctcacacaagtagagggtagaatcgtggttaccaggggctagggagagaaagaaggcagaggcactgaaagatgttggtcaatgggtataaagttacacctaggaagaataaattttggtattcaccacagtagggtgactatagcaaataataatgtagcatgtatttcaagatagctagaaaagcaggtttttaaatgtcaccacaaagaaataacaaatgtttatagtggtggatatggtaattacgcctatttgatcattatactgtgtgtacatgcattgaaacaccacattgtatcccatatatatgtacaattatgtgcccattatacatttaaaaaataaattttaaaaaccttcaattaactcttggtttaaaagaaaaatataaaccaaaactacatgatctctaaaacaaataatgatgatgtaaacacttcatatcagaatccatgggataaatataaagcagtgatcagaggaaattttataactaaacactgctattagtaaaaataaaagattgaaaataaattgatt

SEQ ID NO: 373158 - DNA, 2722 bp, Homo sapiens
acgaggaagaaggaaaacgatttcaagagctgcacttaagcatctagaattttctgcgtcacacctcttgagagaagagactggctccaggtctgactcagtccactacaagctagacggtcttcttaaagcaccaacattacttgagtctttggataaaattgagaaaagagtctacaagtattgtggactctacaggaggcaggaggctgacaactggcagtaaagacaaagatgtcaggcctgcggcccggcactcaagtggaccctgagattgagctttttgtaaaggctggaagtgatggagagagtattggaaactgtcccttttgccaacgccttttcatgatcctctggcttaaaggagttaaatttaatgtgacaactgttgacatgaccaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttaggagagctcttacaggagaaaaggctatatttgtgatcagattttacttattgacatattagaaaggtttttgcaaataagaatatgaaaaatactgtttcttctatccaactctcttatgaaaaggaactctgtattttctattagccataaataatctgtccactgtattttacaggtcttcatacttttacttaattttctttatctgtatggcaaaccactgcaatcctgaatgacatggaaagcatcacaatcttttgccctttgcttgaattcctggaatgcatacatataagctaaacagatgtctgcagttataaatgtcataagtagaggtacaatctcaccctgctccttagaaacatttccatataaatcgctaaaataatttcacatttttgttagtttaatatatacatgagtttatttctgatataaataataaatacagagagtgagcatatcagagaggcaaattcttaaagaatgatttttaaaatcagctctaggaagagctcaagatcaattggtcatagaacagcatttgacgcctagaactatgaccacctcatggtcagagatgagaatgtagcctttgtgaccagattatattatttttaaatgaagaagcactcattaaataaaacataattttaaaaaacaatataagaaacaaagtcaactgaatcttttattcatagaaatgaaaaggaaaataaaaactgtggctgaccaaaaggtcttcttgttgtccataaaaggataaggtaaacagtccttagataattacaaaactttctacaaaagttaaaatgttacattactatacgtattcagattcacttgttaaagtactcttaaatcattcaaatctggaaacaaaagctgaacttaactcttgctccctcaaaagagaaacacaagcataagtgcagcttcaaaaaaggaaaatattttaggctttggtggaagggtggagtttagataaaatttaaatgaagtagcgttttaataggttcaaagaaaagtaaggcaatgagcaaactcaaagtactgtccttgaaaaccatagagtcaagataaatgtatagtgtatggttaggtggcagagaaatgcaatcatgttgataatctttgagatacatcctgtcatcagtatatttcagaatacatgcaatgcactagcaagttacaattgatagaatacatttgaaatgttaaatgaaataagccaggcacagaaagacaaacaccacatgatctcactcatatgtggaattttaaaaagttgatctcactcatatgtggaattttaaaaagttgatctcacacaagtagagggtagaatcgtggttaccaggggctagggagagaaagaaggcagaggcactgaaagatgttggtcaatgggtataaagttacacctaggaagaataaattttggtattcaccacagtagggtgactatagcaaataataatgtagcatgtatttcaagatagctagaaaagcaggtttttaaatgtcaccacaaagaaataacaaatgtttatagtggtggatatggtaattacgcctatttgatcattatactgtgtgtacatgcattgaaacaccacattgtatcccatatatatgtacaattatgtgcccattatacatttaaaaaataaattttaaaaaccttcaattaactcttggtttaaaagaaaaatataaaccaaaactacatgatctctaaaacaaataatgatgatgtaaacacttcatatcagaatccatgggataaatataaagcagtgatcagaggaaattttataactaaacactgctattagtaaaaataaaagattgaaaataaattgatt

SEQ ID NO: 373159 - DNA, 2968 bp, Homo sapiens
acgaggaagaaggaaaacgatttcaagagctgcacttaagcatctagaattttctgcgtcacacctcttgagagaagagactggctccaggtctgactcagtccactacaagctagacggtcttcttaaagcaccaacattacttgagtctttggataaaattgagaaaagagtctacaagtattgtggactctacaggaggcaggaggctgacaactggcagtaaagacaaagatgtcaggcctgcggcccggcactcaagtggaccctgagattgagctttttgtaaaggctggaagtgatggagagagtattggaaactgtcccttttgccaacgccttttcatgatcctctggcttaaaggagttaaatttaatgtgacaactgttgacatgaccagaaagcctgaagaactaaaggacttagccccaggtaccaatcctccgttcctggtgtataacaaggagttgaaaacagacttcattaaaattgaggagtttttagaacaaaccctggctcctccaaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaaatagggtcttgctctgtcacccaggttggagtgcagtggcatgatcaaggcttattgcaacccccacctctgaggctcaagcagtcctcccaccccactcttgagtagctgggactacaggttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttaggagagctcttacaggagaaaaggctatatttgtgatcagattttacttattgacatattagaaaggtttttgcaaataagaatatgaaaaatactgtttcttctatccaactctcttatgaaaaggaactctgtattttctattagccataaataatctgtccactgtattttacaggtcttcatacttttacttaattttctttatctgtatggcaaaccactgcaatcctgaatgacatggaaagcatcacaatcttttgccctttgcttgaattcctggaatgcatacatataagctaaacagatgtctgcagttataaatgtcataagtagaggtacaatctcaccctgctccttagaaacatttccatataaatcgctaaaataatttcacatttttgttagtttaatatatacatgagtttatttctgatataaataataaatacagagagtgagcatatcagagaggcaaattcttaaagaatgatttttaaaatcagctctaggaagagctcaagatcaattggtcatagaacagcatttgacgcctagaactatgaccacctcatggtcagagatgagaatgtagcctttgtgaccagattatattatttttaaatgaagaagcactcattaaataaaacataattttaaaaaacaatataagaaacaaagtcaactgaatcttttattcatagaaatgaaaaggaaaataaaaactgtggctgaccaaaaggtcttcttgttgtccataaaaggataaggtaaacagtccttagataattacaaaactttctacaaaagttaaaatgttacattactatacgtattcagattcacttgttaaagtactcttaaatcattcaaatctggaaacaaaagctgaacttaactcttgctccctcaaaagagaaacacaagcataagtgcagcttcaaaaaaggaaaatattttaggctttggtggaagggtggagtttagataaaatttaaatgaagtagcgttttaataggttcaaagaaaagtaaggcaatgagcaaactcaaagtactgtccttgaaaaccatagagtcaagataaatgtatagtgtatggttaggtggcagagaaatgcaatcatgttgataatctttgagatacatcctgtcatcagtatatttcagaatacatgcaatgcactagcaagttacaattgatagaatacatttgaaatgttaaatgaaataagccaggcacagaaagacaaacaccacatgatctcactcatatgtggaattttaaaaagttgatctcactcatatgtggaattttaaaaagttgatctcacacaagtagagggtagaatcgtggttaccaggggctagggagagaaagaaggcagaggcactgaaagatgttggtcaatgggtataaagttacacctaggaagaataaattttggtattcaccacagtagggtgactatagcaaataataatgtagcatgtatttcaagatagctagaaaagcaggtttttaaatgtcaccacaaagaaataacaaatgtttatagtggtggatatggtaattacgcctatttgatcattatactgtgtgtacatgcattgaaacaccacattgtatcccatatatatgtacaattatgtgcccattatacatttaaaaaataaattttaaaaaccttcaattaactcttggtttaaaagaaaaatataaaccaaaactacatgatctctaaaacaaataatgatgatgtaaacacttcatatcagaatccatgggataaatataaagcagtgatcagaggaaattttataactaaacactgctattagtaaaaataaaagattgaaaataaattgatt

SEQ ID NO: 373160 - DNA, 2788 bp, Homo sapiens
acgaggaagaaggaaaacgatttcaagagctgcacttaagcatctagaattttctgcgtcacacctcttgagagaagagactggctccaggtctgactcagtccactacaagctagacggtcttcttaaagcaccaacattacttgagtctttggataaaattgagaaaagagtctacaagtattgtggactctacaggaggcaggaggctgacaactggcagtaaagacaaagatgtcaggcctgcggcccggcactcaagtggaccctgagattgagctttttgtaaaggctggaagtgatggagagagtattggaaactgtcccttttgccaacgccttttcatgatcctctggcttaaaggagttaaatttaatgtgacaactgttgacatgaccagaaagcctgaagaactaaaggacttagccccaggtaccaatcctccgttcctggtgtataacaaggagttgaaaacagacttcattaaaattgaggagtttttagaacaaaccctggctcctccaaggtaccctcacctgagtcccaagtacaaggagtcttttgatgtgggctgtaacctctttgccaagttttctgcatacattaagaatacacaaaaggaggcaaataagattctggatgaaattgatccagacagtgctgaggaacccccagtttccagaagactattcttggatggggaccagctaacactggctgattgtagcttgttacccaagctgaacattattaaagttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttaggagagctcttacaggagaaaaggctatatttgtgatcagattttacttattgacatattagaaaggtttttgcaaataagaatatgaaaaatactgtttcttctatccaactctcttatgaaaaggaactctgtattttctattagccataaataatctgtccactgtattttacaggtcttcatacttttacttaattttctttatctgtatggcaaaccactgcaatcctgaatgacatggaaagcatcacaatcttttgccctttgcttgaattcctggaatgcatacatataagctaaacagatgtctgcagttataaatgtcataagtagaggtacaatctcaccctgctccttagaaacatttccatataaatcgctaaaataatttcacatttttgttagtttaatatatacatgagtttatttctgatataaataataaatacagagagtgagcatatcagagaggcaaattcttaaagaatgatttttaaaatcagctctaggaagagctcaagatcaattggtcatagaacagcatttgacgcctagaactatgaccacctcatggtcagagatgagaatgtagcctttgtgaccagattatattatttttaaatgaagaagcactcattaaataaaacataattttaaaaaacaatataagaaacaaagtcaactgaatcttttattcatagaaatgaaaaggaaaataaaaactgtggctgaccaaaaggtcttcttgttgtccataaaaggataaggtaaacagtccttagataattacaaaactttctacaaaagttaaaatgttacattactatacgtattcagattcacttgttaaagtactcttaaatcattcaaatctggaaacaaaagctgaacttaactcttgctccctcaaaagagaaacacaagcataagtgcagcttcaaaaaaggaaaatattttaggctttggtggaagggtggagtttagataaaatttaaatgaagtagcgttttaataggttcaaagaaaagtaaggcaatgagcaaactcaaagtactgtccttgaaaaccatagagtcaagataaatgtatagtgtatggttaggtggcagagaaatgcaatcatgttgataatctttgagatacatcctgtcatcagtatatttcagaatacatgcaatgcactagcaagttacaattgatagaatacatttgaaatgttaaatgaaataagccaggcacagaaagacaaacaccacatgatctcactcatatgtggaattttaaaaagttgatctcactcatatgtggaattttaaaaagttgatctcacacaagtagagggtagaatcgtggttaccaggggctagggagagaaagaaggcagaggcactgaaagatgttggtcaatgggtataaagttacacctaggaagaataaattttggtattcaccacagtagggtgactatagcaaataataatgtagcatgtatttcaagatagctagaaaagcaggtttttaaatgtcaccacaaagaaataacaaatgtttatagtggtggatatggtaattacgcctatttgatcattatactgtgtgtacatgcattgaaacaccacattgtatcccatatatatgtacaattatgtgcccattatacatttaaaaaataaattttaaaaaccttcaattaactcttggtttaaaagaaaaatataaaccaaaactacatgatctctaaaacaaataatgatgatgtaaacacttcatatcagaatccatgggataaatataaagcagtgatcagaggaaattttataactaaacactgctattagtaaaaataaaagattgaaaataaattgatt

SEQ ID NO: 373161 - DNA, 692 bp, Homo sapiens
tatgacgctgtgacttttttgtttacaatgttttgctatgtagtatgtgctttctttattccccatcccactatgcatcctttgatacctattttttttttgagatggagttttgctcttgttgcccagaatggagtgcaatggtgtgatctcggctcactgcaacttctgcctcccgggttcaagcaatcctcctgtctcagcctcccaagtagctgggattacaggtatgcaccaccatgcccgtctaactttggatttttagtagagacggggtttcaccatactggtcaggctggtctcaaactcctgacctcaggtgatctaaccatctcaacctcctgaagtgctggggttacaggcatgagacaccgtgcccagcctaatacccatttaaaaaaaaaaaaactttcaattttgaaaataaaacaatccaagaatacagtcatctctaaccatctagacatagggagaagaaaagaaacaatcacacatctttgtagatggaattttttctattacgtaatttttccatacttagccaatcttccctaagcccatgggatttcccatcattgtaagacctaaaatgatgactgcctaataaagaatctgatacttatgaagaatatatttctgccactaaaacccaaacaatccccaaacaactaactaaataaaaatctgcccag

SEQ ID NO: 373162 - DNA, 1153 bp, Homo sapiens
cttcggtaacccgggcaacgcggcctcctggatgtaggaaggggcgctgcccccgaaacacaaatgtctccgccaagaccccagacggttcccaaaggctctccgtgatgcaactgcacgtccctcgaatgcctgggcctccgatatccgtccgccaggagcttggctggatgcacgggcggccagtcctcttatttccccgccctcccgccgcgtggagcggctgctgggtcccgagcctccgggcgggggcgggatcggggcggggcggaggcatctccctcccagcaccgcccccttagctgccccgagccctgcctgcgcccgcccccgaagcggcgcgggacgcctggcgccgtccgcgatccgcagggctgcccgcttaggcttaggcccggcccgctggcaaagccgagccgcagcattttatttcgttcgtggtttccgcacaggctggagtttcgtgggttgggtcgtacttgggacctcggcgaagaggacccgtttatttttttttctttccaaaatggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctga

SEQ ID NO: 373163 - DNA, 598 bp, Homo sapiens
gctgataggccacagctgctgctggctctgcagccttggcagagttgcaaataggttaaacggagatgggagttctagttctcttttgcttcagccagcttccttttctggctaaatctgaataaactcaaaagaaactgggcaaggggtttacggctccccatggtgcttcacaaaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctga

SEQ ID NO: 373164 - DNA, 1325 bp, Homo sapiens
cttcggtaacccgggcaacgcggcctcctggatgtaggaaggggcgctgcccccgaaacacaaatgtctccgccaagaccccagacggttcccaaaggctctccgtgatgcaactgcacgtccctcgaatgcctgggcctccgatatccgtccgccaggagcttggctggatgcacgggcggccagtcctcttatttccccgccctcccgccgcgtggagcggctgctgggtcccgagcctccgggcgggggcgggatcggggcggggcggaggcatctccctcccagcaccgcccccttagctgccccgagccctgcctgcgcccgcccccgaagcggcgcgggacgcctggcgccgtccgcgatccgcagggctgcccgcttaggcttaggcccggcccgctggcaaagccgagccgcagcattttatttcgttcgtggtttccgcacaggctggagtttcgtgggttgggtcgtacttgggacctcggcgaagaggacccgtttatttttttttctttccaaaatggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctgaagaaaaaaaaaaaaaaaaaaacaaaaaaaaaaaaaccccgggggctttttttcgggggggggaaaaagggcaataaaggggccgggccaacgggttccggccccctttttttggaccagggggaaaagggggggcccccaaaagggggggaaaaagaaaacccggtaccgaa

SEQ ID NO: 373165 - DNA, 1702 bp, Homo sapiens
cttcggtaacccgggcaacgcggcctcctggatgtaggaaggggcgctgcccccgaaacacaaatgtctccgccaagaccccagacggttcccaaaggctctccgtgatgcaactgcacgtccctcgaatgcctgggcctccgatatccgtccgccaggagcttggctggatgcacgggcggccagtcctcttatttccccgccctcccgccgcgtggagcggctgctgggtcccgagcctccgggcgggggcgggatcggggcggggcggaggcatctccctcccagcaccgcccccttagctgccccgagccctgcctgcgcccgcccccgaagcggcgcgggacgcctggcgccgtccgcgatccgcagggctgcccgcttaggcttaggcccggcccgctggcaaagccgagccgcagcattttatttcgttcgtggtttccgcacaggctggagtttcgtgggttgggtcgtacttgggacctcggcgaagaggacccgtttatttttttttctttccaaaatggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctgagcctttgaccccagataaacccctcccaattaatgcattttcatttcctactgatacaaggcctggagagggctgttgggggccctcagggagggttcaactctgagacgagaactgccttggtgaaggcaagttcaagcaccacttgagactgggggcagcatggagtagggcagggctacgggggtacacggtgcaccctgcaacttatacctgagcccaacctggtgaatgagagagccccagcctgacccaagcccagggcgactcccataccctgaagcctggggcatgctgggcagcaccggtgcccaaatctggctggtggacagaagcacctggagagttggagagctttttaaaaagacatctctcagcacttccctctctgcagattctgactcagtaagtgaggggtgaggcacagtcatttttctctattctgaagctctcccactgttttcaatgtttaaccaactggggacccctgctctttaagtatattacaggtaataaagatattgtttgtatgcttttaaaaaaaaaaca

SEQ ID NO: 373166 - DNA, 1262 bp, Homo sapiens
gctgataggccacagctgctgctggctctgcagccttggcagagttgcaaataggttaaacggagatgggagttctagttctcttttgcttcagccagcttccttttctggctaaatctgaataaactcaaaagaaactgggcaaggggtttacggctccccatggtgcttcacaaaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctgagcctttgaccccagataaacccctcccaattaatgcattttcatttcctactgatacaaggcctggagagggctgttgggggccctcagggagggttcaactctgagacgagaactgccttggtgaaggcaagttcaagcaccacttgagactgggggcagcatggagtagggcagggctacgggggtacacggtgcaccctgcaacttatacctgagcccagtacaacaaaggtgacgggtgtgtaggtacacacccagagatggagcactgcagatcagcaacctcagccccacctgggaatttgctggaaatgcaggctcaagcccctccccacacctggtgaatgagagagccccagcctgacccaagcccagggcgactcccataccctgaagcctggggcatgctgggcagcaccggtgcccaaatctggctggtggacagaagcacctggagagttggagagctttttaaaaagacatctctcagcacttccctctctgcagattctgactcagtaagtgaggggtgaggcacagtcatttttctctattctgaagctctcccactgttttcaatgtttaaccaactggggacccctgctctttaagtatattacaggtaataaagatattgtttgtatgcttttaaaaaaaaaaca

SEQ ID NO: 373167 - DNA, 1032 bp, Homo sapiens
cttcggtaacccgggcaacgcggcctcctggatgtaggaaggggcgctgcccccgaaacacaaatgtctccgccaagaccccagacggttcccaaaggctctccgtgatgcaactgcacgtccctcgaatgcctgggcctccgatatccgtccgccaggagcttggctggatgcacgggcggccagtcctcttatttccccgccctcccgccgcgtggagcggctgctgggtcccgagcctccgggcgggggcgggatcggggcggggcggaggcatctccctcccagcaccgcccccttagctgccccgagccctgcctgcgcccgcccccgaagcggcgcgggacgcctggcgccgtccgcgatccgcagggctgcccgcttaggcttaggcccggcccgctggcaaagccgagccgcagcattttatttcgttcgtggtttccgcacaggctggagtttcgtgggttgggtcgtacttgggacctcggcgaagaggacccgtttatttttttttctttccaaaatggcagcctccagtcgcgcacaagtgttatctctgtaccgggcgatgctgagagagagcaagcgtttcagcgcctacaattacaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctga

SEQ ID NO: 373168 - DNA, 825 bp, Homo sapiens
cttcggtaacccgggcaacgcggcctcctggatgtaggaaggggcgctgcccccgaaacacaaatgtctccgccaagaccccagacggttcccaaaggctctccgtgatgcaactgcacgtccctcgaatgcctgggcctccgatatccgtccgccaggagcttggctggatgcacgggcggccagtcctcttatttccccgccctcccgccgcgtggagcggctgctgggtcccgagcctccgggcgggggcgggatcggggcggggcggaggcatctccctcccagcaccgcccccttagctgccccgagccctgcctgcgcccgcccccgaagcggcgcgggacgcctggcgccgtccgcgatccgcagggctgcccgcttaggcttaggcccggcccgctggcaaagccgagccgcagcattttatttcgttcgtggtttccgcacaggctggagtttcgtgggttgggtcgtacttgggacctcggcgaagaggacccgtttatttttttttctttccaaaatggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacagatggactctcactctgtcgcccaggctggagtgcattggaacgatctcagctcactacaacctctgcctccctggttcaagcaattctcctg

SEQ ID NO: 373169 - DNA, 988 bp, Homo sapiens
cttcggtaacccgggcaacgcggcctcctggatgtaggaaggggcgctgcccccgaaacacaaatgtctccgccaagaccccagacggttcccaaaggctctccgtgatgcaactgcacgtccctcgaatgcctgggcctccgatatccgtccgccaggagcttggctggatgcacgggcggccagtcctcttatttccccgccctcccgccgcgtggagcggctgctgggtcccgagcctccgggcgggggcgggatcggggcggggcggaggcatctccctcccagcaccgcccccttagctgccccgagccctgcctgcgcccgcccccgaagcggcgcgggacgcctggcgccgtccgcgatccgcagggctgcccgcttaggcttaggcccggcccgctggcaaagccgagccgcagcattttatttcgttcgtggtttccgcacaggctggagtttcgtgggttgggtcgtacttgggacctcggcgaagaggacccgtttatttttttttctttccaaaatggcagcctccagtcgcgcacaagtgttatctctgtaccgggcgatgctgagagagagcaagcgtttcagcgcctacaattacagcagtcctttctttccctggccatgctcacaaagctgggacctacattggatactactgctgcgggtttacaatcctcagttgacctgtctgcggggagacggaagcccctgagtactttgcccaggatgtcttgtctttggaactccactcctccccagcttggcaaaacccttggtgtgctcttcttttaaaacaggatggagtctcactctgtcgcccaggctggagtgcagtggtgctgtttcagctcaccacaacctctgcctcctgggttcaagcaattctcctgcctcagcctcccgagtagctgggattacaggcgcccgtcaccatgcccggctaatttttatatttttaatagagacggggtttcac

SEQ ID NO: 373170 - DNA, 1817 bp, Homo sapiens
cttcggtaacccgggcaacgcggcctcctggatgtaggaaggggcgctgcccccgaaacacaaatgtctccgccaagaccccagacggttcccaaaggctctccgtgatgcaactgcacgtccctcgaatgcctgggcctccgatatccgtccgccaggagcttggctggatgcacgggcggccagtcctcttatttccccgccctcccgccgcgtggagcggctgctgggtcccgagcctccgggcgggggcgggatcggggcggggcggaggcatctccctcccagcaccgcccccttagctgccccgagccctgcctgcgcccgcccccgaagcggcgcgggacgcctggcgccgtccgcgatccgcagggctgcccgcttaggcttaggcccggcccgctggcaaagccgagccgcagcattttatttcgttcgtggtttccgcacaggctggagtttcgtgggttgggtcgtacttgggacctcggcgaagaggacccgtttatttttttttctttccaaaatggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctgagcctttgaccccagataaacccctcccaattaatgcattttcatttcctactgatacaaggcctggagagggctgttgggggccctcagggagggttcaactctgagacgagaactgccttggtgaaggcaagttcaagcaccacttgagactgggggcagcatggagtagggcagggctacgggggtacacggtgcaccctgcaacttatacctgagcccagtacaacaaaggtgacgggtgtgtaggtacacacccagagatggagcactgcagatcagcaacctcagccccacctgggaatttgctggaaatgcaggctcaagcccctccccacacctggtgaatgagagagccccagcctgacccaagcccagggcgactcccataccctgaagcctggggcatgctgggcagcaccggtgcccaaatctggctggtggacagaagcacctggagagttggagagctttttaaaaagacatctctcagcacttccctctctgcagattctgactcagtaagtgaggggtgaggcacagtcatttttctctattctgaagctctcccactgttttcaatgtttaaccaactggggacccctgctctttaagtatattacaggtaataaagatattgtttgtatgcttttaaaaaaaaaaca

SEQ ID NO: 373171 - DNA, 1696 bp, Homo sapiens
cttcggtaacccgggcaacgcggcctcctggatgtaggaaggggcgctgcccccgaaacacaaatgtctccgccaagaccccagacggttcccaaaggctctccgtgatgcaactgcacgtccctcgaatgcctgggcctccgatatccgtccgccaggagcttggctggatgcacgggcggccagtcctcttatttccccgccctcccgccgcgtggagcggctgctgggtcccgagcctccgggcgggggcgggatcggggcggggcggaggcatctccctcccagcaccgcccccttagctgccccgagccctgcctgcgcccgcccccgaagcggcgcgggacgcctggcgccgtccgcgatccgcagggctgcccgcttaggcttaggcccggcccgctggcaaagccgagccgcagcattttatttcgttcgtggtttccgcacaggctggagtttcgtgggttgggtcgtacttgggacctcggcgaagaggacccgtttatttttttttctttccaaaatggcagcctccagtcgcgcacaagtgttatctctgtaccgggcgatgctgagagagagcaagcgtttcagcgcctacaattacaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctgagcctttgaccccagataaacccctcccaattaatgcattttcatttcctactgatacaaggcctggagagggctgttgggggccctcagggagggttcaactctgagacgagaactgccttggtgaaggcaagttcaagcaccacttgagactgggggcagcatggagtagggcagggctacgggggtacacggtgcaccctgcaacttatacctgagcccagtacaacaaaggtgacgggtgtgtaggtacacacccagagatggagcactgcagatcagcaacctcagccccacctgggaatttgctggaaatgcaggctcaagcccctccccacacctggtgaatgagagagccccagcctgacccaagcccagggcgactcccataccctgaagcctggggcatgctgggcagcaccggtgcccaaatctggctggtggacagaagcacctggagagttggagagctttttaaaaagacatctctcagcacttccctctctgcagattctgactcagtaagtgaggggtgaggcacagtcatttttctctattctgaagctctcccactgttttcaatgtttaaccaactggggacccctgctctttaagtatattacaggtaataaagatattgtttgtatgcttttaaaaaaaaaaca

SEQ ID NO: 373172 - DNA, 385 bp, Homo sapiens
tcccctggggttggggggaatatcttactcctacagggaaggacagagttccaaagaccctgaagcacagacctctcttcctgtgcctacctgctcttgatgactgagaactgacccaaaaagatgtacaaattcaggtaagcatctagccctgcgtgtgccctaaaccaagagctcctttctcttagctgtcaatacataaagtcagcgccgattcacagaggcatcagggaggcattgcagggtatgatgaagagttggcttttagcaaacctttaaccaaactcttggctctgcagttctccaagtttagcacatttccccagtgtatcagtagggattcttcgatcacagaaaaaaggaataggtctgactaacttcagca

SEQ ID NO: 373173 - DNA, 732 bp, Homo sapiens
tttttttgagatggagtttcactcttgttgcccaggctggagtgcagtggcacgatcccagctcactgcaacctccacctcctgggttcaaacgattctcctgccttaacctcccaagtagctgattacaaacacagaccaccatgccccgctaatttttgtatttttggtacagatgaggtttcaccatgttggtcaggctggtcttgaacttccgacctcaagtgatccacccgccttggcctcccaaagtgctgggattacaggcatgagccaccgctcgtggcctatttttgttcttatatattttttaataagtttccactctcacaaatttgatacaatagatgatagactatccttttaccatgttttaaaattaaaaaagatggactccacatctgaaatttcttcttgctctgaagaaaacactattttaagaaaatgatatttgaactaattaacctggcttttgactcaaaactcaatttaagtgacatcttaaggactagtgaatggctctttggttaacatttacttagaatccaaataatatctcaaatcataggtaccattttgcatttgagagacagtgatcctaaatgcctaaataagaatagacacacagctctacccctagaaagcatagggtgttatataagtacatttaattgttaattaaaatttcctagaatacctaaagtcaggaagaaatttaacaagaagataatt

SEQ ID NO: 373174 - DNA, 251 bp, Homo sapiens
acaaaacaaatcccccagtggcataaagccccaaatctccagtttctcacatctccaggagaattcctgcagtgaaaacagcaatactggcacagacaatataaactgttactctgcttgaaaagtcacaagggactacacaggaagagctgactctatattgctgttttcctttacagttctaaatacagggacaactttcactgtggagctctgacttacatgaatgttttgtaatggaagccagtgca

SEQ ID NO: 373175 - DNA, 554 bp, Homo sapiens
tgagacagagtcttgctctgtcacccagggtggagtgtagtggcacaatctcagctcactgcaacctctacctcccgggtttgagcaattctcctgcctcagcctccctagtagctgggattacaggtgtgcacaaccacacccggctaatttttgtatttttagtagagacagggttgtaccatgttggccaggctggtctcaaactcctgacctcaggtgacccaactgcctctgcctcccaaagtgctgggattacaggcatgagctaccacacgctgtcaggatttgcatttttaatggccacagtgtaatatcttaacttctcaactagactgtatgttccttgtgagcagagcccaggtcttatgtgtccacggtacttgtcccaccttggtcccagcatcttaactgaaagcagatgctcctgttttcagtgaagaatgtgctctcagtggaacccactcttgatcattcaatgcaaaggaactaaacggtgttcagagacccaacaatgtcatgcaagtatgattccaggacactcctcatttaag

SEQ ID NO: 373176 - DNA, 3508 bp, Homo sapiens
cggtgctggccccggcgaggtagcttctggaaggcgctgctcttccggttctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaaagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagagaaaaggcctcggagtaaacttcccagagctctgagaggtctcatgggtgaagccaacattcgttttgctcgaggagaacgtgaagaggcgatattgatgtgcatggaaatcataagacaagctcctctggcttatgagccattctctactctagccatgatatatgaggaccaaggtgacatggaaaaatcattgcagtttgagttgattgctgcgcatttaaatcccagtgacacagaagaatgggttagactggcagaaatgtctctggaacaagacaatattaagcaggctattttttgctatacaaaagctcttaaatatgaacctactaatgtccgttatctgtgggagcgatcaagcctttatgaacagatgggtgatcataaaatggccatggatggttataggcgtattttaaaccttttgtctccatctgatggcgaacgttttatgcagctggctagagatatggcaaagagttactatgaagccaatgatgttacttctgctattaacataattgatgaagctttctcaaaacaccagggcctagtctccatggaagatgttaacatagcagctgaactatatatttctaacaaacagtatgacaaagctttggagataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatcctctcttgacaacactagtagaacagaatcctgaagatatgggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcaggaactgaagttattgcttcatcgttctactctgttgttttcacaaggcaaaatgtatggttatgtggataccttacttactatgttagccatgcttttaaaggtagcaatgaatcgagcccaagtttgtttgatatccagttccaagtctggagagaggcatctttatcttattaaagtatcgagagacaaaatatcagacagcaatgaccaagagtcagcaaattgtgatgcaaaagcaatatttgctgtgctcacaagcgtcttgacaaaggatgactggtggaatcttctgttgaaggccatatactccttatgtgacctatcccgatttcaagaggctgagttgcttgtagattcctcattggaatattactcattttatgatgacaggcaaaaacgcaaagaactagaatactttggtctgtctgctgcaattctggacaaaaatttcagaaaggcatacaactatatcaggataatggtaatggaaaatgtcaataaaccccagctctggaacattttcaatcaagttaccatgcactcccaagatgtacgacatcatcgcttctgtctccgtttgatgctgaaaaacccagaaaatcatgccctatgtgtcttaaatggacacaatgcatttgtatctggtagttttaagcatgcgcttggacagtatgtgcaagcctttcgcactcaccctgacgaacctctctatagcttctgtataggcctaacctttattcatatggcatctcagaagtatgtgttacggagacatgctcttattgtacagggcttttcctttcttaatcgatacctcagtttacgtgggccctgccaggaatcattctacaatttgggccgtggccttcatcagttggggctgattcatcttgcaatccactattatcagaaggccctggagctccctccacttgtggtagagggtatagaacttgaccagttagacttacgaagagatattgcctacaacttgtctctcatctatcagagcagtgggaataccggaatggctcaaacgcttttgtatacctattgttctatataaagcaccgcaactgagaacagagcaatggcagctgctgtgtgaggaccagtgtcttctgtctcagggcttattatttgtaactccaaaatagaaatgacaatttcagaattacctaacaaacagtgtatttatttttaatatgtgataatgatcttgtggtatatatgcaaaattattcctacaaaaatttgtatattggtctgtcattttcctttcacattctatagtgaattgttcccaatgttgaaatggacgtgtaagcctttgagctagcttggagtcgaatacactatttttcactcacaccatttattcatctttgtatttaatactatagctctgtcaatatcacatgaggcagtttttcaaatacgtataaacagaggttgcttattattaaaggaaagacaaagtgggactctttatgatgtcatgaccatgataactaagcacctaagaaaattatttaaaatagttatgtggtaggcagaaagacaaataatttagttttttacttttcaccagcatgtatcttagctacctaaactgaaacatgggaggctgggcttaattcaaaatatattgctccaaggcaaataaaaaaatgctttatctatatttgtggctttctgatgaaaaaatagagaagagcttgttcaataacaggacatggtttccatttcaagatcacaagtaatataagactgggcaagtagtacgtatggaataaaggacatactgctgattgataaag

SEQ ID NO: 373177 - DNA, 3099 bp, Homo sapiens
agagtgcagtggcgtgatcttggctcactgtaacctccgcctcccaggttcaagtgattctcatgcctcagcctaccaagtagctgagattgtgggagaaaaggcctcggagtaaacttcccagagctctgagaggtctcatgggtgaagccaacattcgttttgctcgaggagaacgtgaagaggcgatattgatgtgcatggaaatcataagacaagctcctctggcttatgagccattctctactctagccatgatatatgaggaccaaggtgacatggaaaaatcattgcagtttgagttgattgctgcgcatttaaatcccagtgacacagaagaatgggttagactggcagaaatgtctctggaacaagacaatattaagcaggctattttttgctatacaaaagctcttaaatatgaacctactaatgtccgttatctgtgggagcgatcaagcctttatgaacagatgggtgatcataaaatggccatggatggttataggcgtattttaaaccttttgtctccatctgatggcgaacgttttatgcagctggctagagatatggcaaagagttactatgaagccaatgatgttacttctgctattaacataattgatgaagctttctcaaaacaccagggcctagtctccatggaagatgttaacatagcagctgaactatatatttctaacaaacagtatgacaaagctttggagataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatcctctcttgacaacactagtagaacagaatcctgaagatatgggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcaggaactgaagttattgcttcatcgttctactctgttgttttcacaaggcaaaatgtatggttatgtggataccttacttactatgttagccatgcttttaaaggtagcaatgaatcgagcccaagtttgtttgatatccagttccaagtctggagagaggcatctttatcttattaaagtatcgagagacaaaatatcagacagcaatgaccaagagtcagcaaattgtgatgcaaaagcaatatttgctgtgctcacaagcgtcttgacaaaggatgactggtggaatcttctgttgaaggccatatactccttatgtgacctatcccgatttcaagaggctgagttgcttgtagattcctcattggaatattactcattttatgatgacaggcaaaaacgcaaagaactagaatactttggtctgtctgctgcaattctggacaaaaatttcagaaaggcatacaactatatcaggataatggtaatggaaaatgtcaataaaccccagctctggaacattttcaatcaagttaccatgcactcccaagatgtacgacatcatcgcttctgtctccgtttgatgctgaaaaacccagaaaatcatgccctatgtgtcttaaatggacacaatgcatttgtatctggtagttttaagcatgcgcttggacagtatgtgcaagcctttcgcactcaccctgacgaacctctctatagcttctgtataggcctaacctttattcatatggcatctcagaagtatgtgttacggagacatgctcttattgtacagggcttttcctttcttaatcgatacctcagtttacgtgggccctgccaggaatcattctacaatttgggccgtggccttcatcagttggggctgattcatcttgcaatccactattatcagaaggccctggagctccctccacttgtggtagagggtatagaacttgaccagttagacttacgaagagatattgcctacaacttgtctctcatctatcagagcagtgggaataccggaatggctcaaacgcttttgtatacctattgttctatataaagcaccgcaactgagaacagagcaatggcagctgctgtgtgaggaccagtgtcttctgtctcagggcttattatttgtaactccaaaatagaaatgacaatttcagaattacctaacaaacagtgtatttatttttaatatgtgataatgatcttgtggtatatatgcaaaattattcctacaaaaatttgtatattggtctgtcattttcctttcacattctatagtgaattgttcccaatgttgaaatggacgtgtaagcctttgagctagcttggagtcgaatacactatttttcactcacaccatttattcatctttgtatttaatactatagctctgtcaatatcacatgaggcagtttttcaaatacgtataaacagaggttgcttattattaaaggaaagacaaagtgggactctttatgatgtcatgaccatgataactaagcacctaagaaaattatttaaaatagttatgtggtaggcagaaagacaaataatttagttttttacttttcaccagcatgtatcttagctacctaaactgaaacatgggaggctgggcttaattcaaaatatattgctccaaggcaaataaaaaaatgctttatctatatttgtggctttctgatgaaaaaatagagaagagcttgttcaataacaggacatggtttccatttcaagatcacaagtaatataagactgggcaagtagtacgtatggaataaaggacatactgctgattgataaag

SEQ ID NO: 373178 - DNA, 3670 bp, Homo sapiens
cggtgctggccccggcgaggtagcttctggaaggcgctgctcttccggttctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaaagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagagaaaaggcctcggagtaaacttcccagagctctgagaggtctcatgggtgaagccaacattcgttttgctcgaggagaacgtgaagaggcgatattgatgtgcatggaaatcataagacaagctcctctggcttatgagccattctctactctagccatgatatatgaggaccaaggtgacatggaaaaatcattgcagtttgagttgattgctgcgcatttaaatcccagtgacacagaagaatgggttagactggcagaaatgtctctggaacaagacaatattaagcaggctattttttgctatacaaaagctcttaaatatgaacctactaatgtccgttatctgtgggagcgatcaagcctttatgaacagatgggtgatcataaaatggccatggatggttataggcgtattttaaaccttttgtctccatctgatggcgaacgttttatgcagctggctagagatatggcaaagagttactatgaagccaatgatgttacttctgctattaacataattgatgaagctttctcaaaacaccagggcctagtctccatggaagatgttaacatagcagctgaactatatatttctaacaaacagtatgacaaagctttggagataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatcctctcttgacaacactagtagaacagaatcctgaagatatgggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcaggaactgaagttattgcttcatcgttctactctgttgttttcacaaggcaaaatgtatggttatgtggataccttacttactatgttagccatgcttttaaagatggtactgtctagttgcaggaaaacaagctcagggctcccactgattctacattatgcaatatttgctgtgctcacaagcgtcttgacaaaggatgactggtggaatcttctgttgaaggccatatactccttatgtgacctatcccgatttcaagaggctgagttgcttgtagattcctcattggaatattactcattttatgatgacaggcaaaaacgcaaagaactagaatactttggtctgtctgctgcaattctggacaaaaatttcagaaaggcatacaactatatcaggataatggtaatggaaaatgtcaataaaccccagctctggaacattttcaatcaagttaccatgcactcccaagatgtacgacatcatcgcttctgtctccgtttgatgctgaaaaacccagaaaatcatgccctatgtgtcttaaatggacacaatgcatttgtatctggtagttttaagcatgcgcttggacagtatgtgcaagcctttcgcactcaccctgacgaacctctctatagcttctgtataggcctaacctttattcatatggcatctcagaagtatgtgttacggagacatgctcttattgtacagggcttttcctttcttaatcgatacctcagtttacgtgggccctgccaggaatcattctacaatttgggccgtggccttcatcagttggggctgattcatcttgcaatccactattatcagaaggccctggagctccctccacttgtggtagagggtatagaacttgaccagttagacttacgaagagatattgcctacaacttgtctctcatctatcagagcagtgggaataccggaatggctcaaacgcttttgtatacctattgttctatataaagcaccgcaactgagaacagagcaatggcagctgctgtgtgaggaccagtgtcttctgtctcagggcttattatttgtaactccaaaatagaaatgacaatttcagaattacctaacaaacagtgtatttatttttaatatgtgataatgatcttgtggtatatatgcaaaattattcctacaaaaatttgtatattggtctgtcattttcctttcacattctatagtgaattgttcccaatgttgaaatggacgtgtaagcctttgagctagcttggagtcgaatacactatttttcactcacaccatttattcatctttgtatttaatactatagctctgtcaatatcacatgaggcagtttttcaaatacgtataaacagaggttgcttattattaaaggaaagacaaagtgggactctttatgatgtcatgaccatgataactaagcacctaagaaaattatttaaaatagttatgtggtaggcagaaagacaaataatttagttttttacttttcaccagcatgtatcttagctacctaaactgaaacatgggaggctgggcttaattcaaaatatattgctccaaggcaaataaaaaaatgctttatctatatttgtggctttctgatgaaaaaatagagaagagcttgttcaataacaggacatggtttccatttcaagatcacaagtaatataagactgggcaagtagtacgtatggaataaaggacatactgctgattgataaagtaaaaaactttttttttgtttgtttactcatctccactatttattatatgttcttgaatttaagttaacagtactttttagatgatatactgttagcttaataacaactttttagggaaaaataaatgctgtaattaatgtgcacatgggttagtaacacccagcccaattgtgggagggaaacaagtagaggcttaggatcaaagaaataaaattgggacttattagaaattcttacca

SEQ ID NO: 373179 - DNA, 2673 bp, Homo sapiens
gaaaaccctggcagcttttactatatgtactaagcatacagtttgacaaagctaaggacataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatcctctcttgacaacactagtagaacagaatcctgaagatatgggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcaggaactgaagttattgcttcatcgttctactctgttgttttcacaaggcaaaatgtatggttatgtggataccttacttactatgttagccatgcttttaaaggtagcaatgaatcgagcccaagtttgtttgatatccagttccaagtctggagagaggcatctttatcttattaaagtatcgagagacaaaatatcagacagcaatgaccaagagtcagcaaattgtgatgcaaaagcaatatttgctgtgctcacaagcgtcttgacaaaggatgactggtggaatcttctgttgaaggccatatactccttatgtgacctatcccgatttcaagaggctgagttgcttgtagattcctcattggaatattactcattttatgatgacaggcaaaaacgcaaagaactagaatactttggtctgtctgctgcaattctggacaaaaatttcagaaaggcatacaactatatcaggataatggtaatggaaaatgtcaataaaccccagctctggaacattttcaatcaagttaccatgcactcccaagatgtacgacatcatcgcttctgtctccgtttgatgctgaaaaacccagaaaatcatgccctatgtgtcttaaatggacacaatgcatttgtatctggtagttttaagcatgcgcttggacagtatgtgcaagcctttcgcactcaccctgacgaacctctctatagcttctgtataggcctaacctttattcatatggcatctcagaagtatgtgttacggagacatgctcttattgtacagggcttttcctttcttaatcgatacctcagtttacgtgggccctgccaggaatcattctacaatttgggccgtggccttcatcagttggggctgattcatcttgcaatccactattatcagaaggccctggagctccctccacttgtggtagagggtatagaacttgaccagttagacttacgaagagatattgcctacaacttgtctctcatctatcagagcagtgggaataccggaatggctcaaacgcttttgtatacctattgttctatataaagcaccgcaactgagaacagagcaatggcagctgctgtgtgaggaccagtgtcttctgtctcagggcttattatttgtaactccaaaatagaaatgacaatttcagaattacctaacaaacagtgtatttatttttaatatgtgataatgatcttgtggtatatatgcaaaattattcctacaaaaatttgtatattggtctgtcattttcctttcacattctatagtgaattgttcccaatgttgaaatggacgtgtaagcctttgagctagcttggagtcgaatacactatttttcactcacaccatttattcatctttgtatttaatactatagctctgtcaatatcacatgaggcagtttttcaaatacgtataaacagaggttgcttattattaaaggaaagacaaagtgggactctttatgatgtcatgaccatgataactaagcacctaagaaaattatttaaaatagttatgtggtaggcagaaagacaaataatttagttttttacttttcaccagcatgtatcttagctacctaaactgaaacatgggaggctgggcttaattcaaaatatattgctccaaggcaaataaaaaaatgctttatctatatttgtggctttctgatgaaaaaatagagaagagcttgttcaataacaggacatggtttccatttcaagatcacaagtaatataagactgggcaagtagtacgtatggaataaaggacatactgctgattgataaagtaaaaaactttttttttgtttgtttactcatctccactatttattatatgttcttgaatttaagttaacagtactttttagatgatatactgttagcttaataacaactttttagggaaaaataaatgctgtaattaatgtgcacatgggttagtaacacccagcccaattgtgggagggaaacaagtagaggcttaggatcaaagaaataaaattgggacttattagaaattcttacca

SEQ ID NO: 373180 - DNA, 2475 bp, Homo sapiens
cggtgctggccccggcgaggtagcttctggaaggcgctgctcttccggttctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaaagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagagaaaaggcctcggagtaaacttcccagagctctgagaggtctcatgggtgaagccaacattcgttttgctcgaggagaacgtgaagaggcgatattgatgtgcatggaaatcataagacaagctcctctggcttatgagccattctctactctagccatgatatatgaggaccaaggtgacatggaaaaatcattgcagtttgagttgattgctgcgcatttaaatcccagtgacacagaagaatgggttagactggcagaaatgtctctggaacaagacaatattaagcaggctattttttgctatacaaaagctcttaaatatgaacctactaatgtccgttatctgtgggagcgatcaagcctttatgaacagatgggtgatcataaaatggccatggatggttataggcgtattttaaaccttttgtctccatctgatggcgaacgttttatgcagctggctagagatatggcaaagagttactatgaagccaatgatgttacttctgctattaacataattgatgaagctttctcaaaacaccagggcctagtctccatggaagatgttaacatagcagctgaactatatatttctaacaaacagtatgacaaagctttggagataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatcctctcttgacaacactagtagaacagaatcctgaagatatgggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcaggaactgaagttattgcttcatcgttctactctgttgttttcacaaggcaaaatgtatggttatgtggataccttacttactatgttagccatgcttttaaaggtagcaatgaatcgagcccaagtttgtttgatatccagttccaagtctggagagaggcatctttatcttattaaagtatcgagagacaaaatatcagacagcaatgaccaagagtcagcaaattgtgatgcaaaagcaatatttgctgtgctcacaagcgtcttgacaaaggatgactggtggaatcttctgttgaaggccatatactccttatgtgacctatcccgatttcaagaggctgagttgcttgtagattcctcattggaatattactcattttatgatgacaggcaaaaacgcaaagaactagaatactttggtctgtctgctgcaattctggacaaaaatttcagaaaggcatacaactatatcaggataatggtaatggaaaatgtcaataaaccccagctctggaacattttcaatcaagttaccatgcactcccaagatgtacgacatcatcgcttctgtctccgtttgatgctgaaaaacccagaaaatcatgccctatgtgtcttaaatggacacaatgcatttgtatctggtagttttaagcatgcgcttggacagtatgtgcaagcctttcgcactcaccctgacgaacctctctatagcttcgtaagtctaactggtcaagttctataccctctaccacaagtcgacgcggccgcgaatttagtagtagta

SEQ ID NO: 373181 - DNA, 1751 bp, Homo sapiens
cggtgctggccccggcgaggtagcttctggaaggcgctgctcttccggttctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaaagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagagaaaaggcctcggagtaaacttcccagagctctgagaggtctcatgggtgaagccaacattcgttttgctcgaggagaacgtgaagaggcgatattgatgtgcatggaaatcataagacaagctcctctggcttatgagccattctctactctagccatgatatatgaggaccaaggtgacatggaaaaatcattgcagtttgagttgattgctgcgcatttaaatcccagtgacacagaagaatgggttagactggcagaaatgtctctggaacaagacaatattaagcaggctattttttgctatacaaaagctcttaaatatgaacctactaatgtccgttatctgtgggagcgatcaagcctttatgaacagatgggtgatcataaaatggccatggatggttataggcgtattttaaaccttttgtctccatctgatggcgaacgttttatgcagctggctagagatatggcaaagagttactatgaagccaatgatgttacttctgctattaacataattgatgaagctttctcaaaacaccagggcctagtctccatggaagatgttaacatagcagctgaactatatatttctaacaaacagtatgacaaagctttggagataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatcctctcttgacaacactagtagaacagaatcctgaagatatgggagacctatacctagatgttgctgaagcttttctggatgttggtgaatataattctgcacttcccctcctcagtgctcttgtttgctctgaaagatacaaccttgcagtagtttggcttcgtcatgcaggtaacacttttttgtgggaggaagaagttttaatcatataagcagccaagaacttactttcccaagatggtaataattattatagtgcaagtgtttctggtttcaggggagttttttgaaagtcagtattttaaattgtcttgctaggctactaagtgatttccccatcactaatgctttggaggaatgatttacttaatgatgccagagtgaagttgaaggactcacatttcccttagatgcctgtcttgaacctctcttaaccata

SEQ ID NO: 373182 - DNA, 348 bp, Homo sapiens
gaagaaaatcccgatgactctgaagttccatcatcatcaggaattaactctaccaaatcccaagacaaagatgtcaatgaaggtatgttaaaattatgtgcttcctgcaatgaatgtttagagtatgtaagcaaagtaatttagtgaaacattgtattttcatggcagtgatactctgttgttgattacctggtttttcaggaacagaatgcttggttatatagtaggtgcccaataaatatttgttgagttattgaataccctgatggttattttttgtgagctctggtgttggaaaagtgttttaaattgacatcagtatttgtttgggagctttttaagattatt

SEQ ID NO: 373183 - DNA, 432 bp, Homo sapiens
atatttgatgatgctgttaactgaatcagcattgatccaaggtatatgcatagttttataatttttttttagtacatgagctttaataccttttgaaaacttacttacacttataaaactattaatttgccataaaattgtcccggttgacagttggaaatattaaacataaaggtatctttttctccctagggtatagaacttgaccagttagacttacgaagagatattgcctacaacttgtctctcatctatcagagcagtgggaataccggaatggctcaaacgcttttgtatacctattgttctatataaagcaccgcaactgagaacagagcaatggcagctgctgtgtgaggaccagtgtcttctgtctcagggcttattatttgtaactccaaaatagaaatgacaatttcagaattacctaac

SEQ ID NO: 373184 - DNA, 451 bp, Homo sapiens
ctaaggtgagaggatcacttgagcttaggagttcaaatccagcctgagccaacataacaagactttgtctctaaacaaaacagttattgtttaaagaatctgaaatcttcatctttaattcaggtagcaatgaatcgagcccaagtttgtttgatatccagttccaagtctggagagaggcatctttatcttattaaagtatcgagagacaaaatatcagacagcaatgaccaagagtcagcaaattgtgatgcaaaaggtaataacttcatttgcattatgttatataaaatttggctgaattgaaaaagactcatgaagtaacactggacagcaatctaattgaaaatatacttttcaaataaaatgaaattttccaatctaaatctctcaagtgtaataaactcattcgatgttaaaaaggaaaggctaaatgtaaatactttaaatt

SEQ ID NO: 373185 - DNA, 270 bp, Homo sapiens
cttccggttctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaagtgaggcgatgctaggccacggtgcccttcactcttgttgccttcatacccttaggtgtgggggacccagacgaccgctttcactgtgatggggcgggctgggaactttcagcagc

SEQ ID NO: 373186 - DNA, 750 bp, Homo sapiens
cggtgctggccccggcgaggtagcttctggaaggcgctgctcttccggttctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaagtgaggcgatgctaggccacggtgcccttcactcttgttgccttcatacccttagagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaaaaaaaaaaacaaaaaaaaacacctgtgtttgggccggcatctgggcccttgaaaaaagtttttataacaccattcggttgggcgcgccggggcccccagtaggggtaggtagacctggggcaataggcggtgttcccaaggagaaactcgggcgcaagacaaaggggcgtgaggttctcacccatataaag

SEQ ID NO: 373187 - DNA, 3748 bp, Homo sapiens
cggtgctggccccggcgaggtagcttctggaaggcgctgctcttccggttctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaaagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagagaaaaggcctcggagtaaacttcccagagctctgagaggtctcatgggtgaagccaacattcgttttgctcgaggagaacgtgaagaggcgatattgatgtgcatggaaatcataagacaagctcctctggcttatgagccattctctactctagccatgatatatgaggaccaaggtgacatggaaaaatcattgcagtttgagttgattgctgcgcatttaaatcccagtgacacagaagaatgggttagactggcagaaatgtctctggaacaagacaatattaagcaggctattttttgctatacaaaagctcttaaatatgaacctactaatgtccgttatctgtgggagcgatcaagcctttatgaacagatgggtgatcataaaatggccatggatggttataggcgtattttaaaccttttgtctccatctgatggcgaacgttttatgcagctggctagagatatggcaaagagttactatgaagccaatgatgttacttctgctattaacataattgatgaagctttctcaaaacaccagggcctagtctccatggaagatgttaacatagcagctgaactatatatttctaacaaacagtatgacaaagctttggagataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatcctctcttgacaacactagtagaacagaatcctgaagatatgggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcaggaactgaagttattgcttcatcgttctactctgttgttttcacaaggcaaaatgtatggttatgtggataccttacttactatgttagccatgcttttaaaggtagcaatgaatcgagcccaagtttgtttgatatccagttccaagtctggagagaggcatctttatcttattaaagtatcgagagacaaaatatcagacagcaatgaccaagagtcagcaaattgtgatgcaaaagcaatatttgctgtgctcacaagcgtcttgacaaaggatgactggtggaatcttctgttgaaggccatatactccttatgtgacctatcccgatttcaagaggctgagttgcttgtagattcctcattggaatattactcattttatgatgacaggcaaaaacgcaaagaactagaatactttggtctgtctgctgcaattctggacaaaaatttcagaaaggcatacaactatatcaggataatggtaatggaaaatgtcaataaaccccagctctggaacattttcaatcaagttaccatgcactcccaagatgtacgacatcatcgcttctgtctccgtttgatgctgaaaaacccagaaaatcatgccctatgtgtcttaaatggacacaatgcatttgtatctggtagttttaagcatgcgcttggacagtatgtgcaagcctttcgcactcaccctgacgaacctctctatagcttctgtataggcctaacctttattcatatggcatctcagaagtatgtgttacggagacatgctcttattgtacagggcttttcctttcttaatcgatacctcagtttacgtgggccctgccaggaatcattctacaatttgggccgtggccttcatcagttggggctgattcatcttgcaatccactattatcagaaggccctggagctccctccacttgtggtagagggtatagaacttgaccagttagacttacgaagagatattgcctacaacttgtctctcatctatcagagcagtgggaataccggaatggctcaaacgcttttgtatacctattgttctatataaagcaccgcaactgagaacagagcaatggcagctgctgtgtgaggaccagtgtcttctgtctcagggcttattatttgtaactccaaaatagaaatgacaatttcagaattacctaacaaacagtgtatttatttttaatatgtgataatgatcttgtggtatatatgcaaaattattcctacaaaaatttgtatattggtctgtcattttcctttcacattctatagtgaattgttcccaatgttgaaatggacgtgtaagcctttgagctagcttggagtcgaatacactatttttcactcacaccatttattcatctttgtatttaatactatagctctgtcaatatcacatgaggcagtttttcaaatacgtataaacagaggttgcttattattaaaggaaagacaaagtgggactctttatgatgtcatgaccatgataactaagcacctaagaaaattatttaaaatagttatgtggtaggcagaaagacaaataatttagttttttacttttcaccagcatgtatcttagctacctaaactgaaacatgggaggctgggcttaattcaaaatatattgctccaaggcaaataaaaaaatgctttatctatatttgtggctttctgatgaaaaaatagagaagagcttgttcaataacaggacatggtttccatttcaagatcacaagtaatataagactgggcaagtagtacgtatggaataaaggacatactgctgattgataaagtaaaaaactttttttttgtttgtttactcatctccactatttattatatgttcttgaatttaagttaacagtactttttagatgatatactgttagcttaataacaactttttagggaaaaataaatgctgtaattaatgtgcacatgggttagtaacacccagcccaattgtgggagggaaacaagtagaggcttaggatcaaagaaataaaattgggacttattagaaattcttacca

SEQ ID NO: 373188 - DNA, 3100 bp, Homo sapiens
ctgaggatccccaactctgccacccacagcggcacagtcacacggtactgagtaggttttcagtgagggtcagcaggaaccaggaaaatgaggaaagagaaaaggcctcggagtaaacttcccagagctctgagaggtctcatgggtgaagccaacattcgttttgctcgaggagaacgtgaagaggcgatattgatgtgcatggaaatcataagacaagctcctctggcttatgagccattctctactctagccatgatatatgaggaccaaggtgacatggaaaaatcattgcagtttgagttgattgctgcgcatttaaatcccagtgacacagaagaatgggttagactggcagaaatgtctctggaacaagacaatattaagcaggctattttttgctatacaaaagctcttaaatatgaacctactaatgtccgttatctgtgggagcgatcaagcctttatgaacagatgggtgatcataaaatggccatggatggttataggcgtattttaaaccttttgtctccatctgatggcgaacgttttatgcagctggctagagatatggcaaagagttactatgaagccaatgatgttacttctgctattaacataattgatgaagctttctcaaaacaccagggcctagtctccatggaagatgttaacatagcagctgaactatatatttctaacaaacagtatgacaaagctttggagataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatcctctcttgacaacactagtagaacagaatcctgaagatatgggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcaggaactgaagttattgcttcatcgttctactctgttgttttcacaaggcaaaatgtatggttatgtggataccttacttactatgttagccatgcttttaaaggtagcaatgaatcgagcccaagtttgtttgatatccagttccaagtctggagagaggcatctttatcttattaaagtatcgagagacaaaatatcagacagcaatgaccaagagtcagcaaattgtgatgcaaaagcaatatttgctgtgctcacaagcgtcttgacaaaggatgactggtggaatcttctgttgaaggccatatactccttatgtgacctatcccgatttcaagaggctgagttgcttgtagattcctcattggaatattactcattttatgatgacaggcaaaaacgcaaagaactagaatactttggtctgtctgctgcaattctggacaaaaatttcagaaaggcatacaactatatcaggataatggtaatggaaaatgtcaataaaccccagctctggaacattttcaatcaagttaccatgcactcccaagatgtacgacatcatcgcttctgtctccgtttgatgctgaaaaacccagaaaatcatgccctatgtgtcttaaatggacacaatgcatttgtatctggtagttttaagcatgcgcttggacagtatgtgcaagcctttcgcactcaccctgacgaacctctctatagcttctgtataggcctaacctttattcatatggcatctcagaagtatgtgttacggagacatgctcttattgtacagggcttttcctttcttaatcgatacctcagtttacgtgggccctgccaggaatcattctacaatttgggccgtggccttcatcagttggggctgattcatcttgcaatccactattatcagaaggccctggagctccctccacttgtggtagagggtatagaacttgaccagttagacttacgaagagatattgcctacaacttgtctctcatctatcagagcagtgggaataccggaatggctcaaacgcttttgtatacctattgttctatataaagcaccgcaactgagaacagagcaatggcagctgctgtgtgaggaccagtgtcttctgtctcagggcttattatttgtaactccaaaatagaaatgacaatttcagaattacctaacaaacagtgtatttatttttaatatgtgataatgatcttgtggtatatatgcaaaattattcctacaaaaatttgtatattggtctgtcattttcctttcacattctatagtgaattgttcccaatgttgaaatggacgtgtaagcctttgagctagcttggagtcgaatacactatttttcactcacaccatttattcatctttgtatttaatactatagctctgtcaatatcacatgaggcagtttttcaaatacgtataaacagaggttgcttattattaaaggaaagacaaagtgggactctttatgatgtcatgaccatgataactaagcacctaagaaaattatttaaaatagttatgtggtaggcagaaagacaaataatttagttttttacttttcaccagcatgtatcttagctacctaaactgaaacatgggaggctgggcttaattcaaaatatattgctccaaggcaaataaaaaaatgctttatctatatttgtggctttctgatgaaaaaatagagaagagcttgttcaataacaggacatggtttccatttcaagatcacaagtaatataagactgggcaagtagtacgtatggaataaaggacatactgctgattgataaag

SEQ ID NO: 373189 - DNA, 3033 bp, Homo sapiens
cggtgctggccccggcgaggtagcttctggaaggcgctgctcttccggttctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaaagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagagaaaaggcctcggagtaaacttcccagagctctgagaggtctcatgggtgaagccaacattcgttttgctcgaggagaacgtgaagaggcgatattgatgtgcatggaaatcataagacaagctcctctggcttatgagccattctctactctagccatgatatatgaggaccaaggtgacatggaaaaatcattgcagtttgagttgattgctgcgcatttaaatcccagtgacacagaagaatgggttagactggcagaaatgtctctggaacaagacaatattaagcaggctattttttgctatacaaaagctcttaaatatgaacctactaatgtccgttatctgtgggagcgatcaagcctttatgaacagatgggtgatcataaaatggccatggatggttataggcgtattttaaaccttttgtctccatctgatggcgaacgttttatgcagctggctagagatatggcaaagagttactatgaagccaatgatgttacttctgctattaacataattgatgaagctttctcaaaacaccagggcctagtctccatggaagatgttaacatagcagctgaactatatatttctaacaaacagtatgacaaagctttggagataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatcctctcttgacaacactagtagaacagaatcctgaagatatgggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcaggaactgaagttattgcttcatcgttctactctgttgttttcacaaggcaaaatgtatggttatgtggataccttacttactatgttagccatgcttttaaaggtagcaatgaatcgagcccaagtttgtttgatatccagttccaagtctggagagaggcatctttatcttattaaagtatcgagagacaaaatatcagacagcaatgaccaagagtcagcaaattgtgatgcaaaagcaatatttgctgtgctcacaagcgtcttgacaaaggatgactggtggaatcttctgttgaaggccatatactccttatgtgacctatcccgatttcaagaggctgagttgcttgtagattcctcattggaatattactcattttatgatgacaggcaaaaacgcaaagaactagaatactttggtctgtctgctgcaattctggacaaaaatttcagaaaggcatacaactatatcaggataatggtaatggaaaatgtcaataaaccccagctctggaacattttcaatcaagttaccatgcactcccaagatgtacgacatcatcgcttctgtctccgtttgatgctgaaaaacccagaaaatcatgccctatgtgtcttaaatggacacaatgcatttgtatctggtagttttaagcatgcgcttggacagtatgtgcaagcctttcgcactcaccctgacgaacctctctatagcttctgtataggcctaacctttattcatatggcatctcagaagtatgtgttacggagacatgctcttattgtacagggcttttcctttcttaatcgatacctcagtttacgtgggccctgccaggaatcattctacaatttgggccgtggccttcatcagttggggctgattcatcttgcaatccactattatcagaaggccctggagctccctccacttgtggtagagggtatagaacttgaccagttagacttacgaagagatattgcctacaacttgtctctcatctatcagagcagtgggaataccggaatggctcaaacgcttttgtatacctattgttctatataaagcaccgcaactgagaacagagcaatggcagctgctgtgtgaggaccagtgtcttctgtctcagggcttattatttgtaactccaaaaaaaaaaaaacaaaaaaaaacacctgtgtttgggccggcatctgggcccttgaaaaaagtttttataacaccattcggttgggcgcgccggggcccccagtaggggtaggtagacctggggcaataggcggtgttcccaaggagaaactcgggcgcaagacaaaggggcgtgaggttctcacccatataaag

SEQ ID NO: 373190 - DNA, 2116 bp, Homo sapiens
cggtgctggccccggcgaggtagcttctggaaggcgctgctcttccggttctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaaagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagagaaaaggcctcggagtaaacttcccagagctctgagaggtctcatgggtgaagccaacattcgttttgctcgaggagaacgtgaagaggcgatattgatgtgcatggaaatcataagacaagctcctctggcttatgagccattctctactctagccatgatatatgaggaccaaggtgacatggaaaaatcattgcagtttgagttgattgctgcgcatttaaatcccagtgacacagaagaatgggttagactggcagaaatgtctctggaacaagacaatattaagcaggctattttttgctatacaaaagctcttaaatatgaacctactaatgtccgttatctgtgggagcgatcaagcctttatgaacagatgggtgatcataaaatggccatggatggttataggcgtattttaaaccttttgtctccatctgatggcgaacgttttatgcagctggctagagatatggcaaagagttactatgaagccaatgatgttacttctgctattaacataattgatgaagctttctcaaaacaccagggcctagtctccatggaagatgttaacatagcagctgaactatatatttctaacaaacagtatgacaaagctttggagataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatcctctcttgacaacactagtagaacagaatcctgaagatatgggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcaggaactgaagttattgcttcatcgttctactctgttgttttcacaaggcaaaatgtatggttatgtggataccttacttactatgttagccatgcttttaaaggtagcaatgaatcgagcccaagtttgtttgatatccagttccaagtctggagagaggcatctttatcttattaaagtatcgagagacaaaatatcagacagcaatgaccaagagtcagcaaattgtgatgcaaaaggtaataacttcatttgcattatgttatataaaatttggctgaattgaaaaagactcatgaagtaacactggacagcaatctaattgaaaatatacttttcaaataaaatgaaattttccaatctaaatctctcaagtgtaataaactcattcgatgttaaaaaggaaaggctaaatgtaaatactttaaatt

SEQ ID NO: 373191 - DNA, 634 bp, Homo sapiens
ttttttttttaatttaagtggtctcactctgttacccaggatggagtgcagtggtgtgatcacggctcactgcagcctcaacctcccaatctcaagcaatcctcccacctcagcctcccgagaagctaggactacaggcgtgtgccaccatgcccaactcttaaaaaaacttttttttttttttttgtagctatgggggtctcactttgttgtccaggctgacagaactgcatttttaattctatagaaatataattctttataggacttcctggtcaatacagtaatgtaagtttgagctcttgattcttcatcgccataattcccttctgcatatactgcatatggaaacatataattgagcatctgtgttccaggcattgtggctctaacccaagttgtctgagtatatcctagaagtctctgaagtactgtttatcttctttccctttttgttacttcttcacactttccttttggccacctttacagtgagtaaagtaggtggatagagacctttgaaaaagtatatctgtgttcctcaaacaagtcagttttagtgactattacctttggagataaagtccagttccttagagtggcttctgcagccatccatgatctctgaatctca

SEQ ID NO: 373192 - DNA, 452 bp, Homo sapiens
cctctactgagactgcatcacagctctccctcctccctgcgctgagtcctctccctttcctcctcctcctgcaggtcttgacctgggagcacccctaacaaacctcttacgtgccgacctccacctccattggcttcctggagactcaacctgccacgtatcatgtttctcacaaggactaaattgcatagaacataaagttctaagctgggcgctgtggctcacgcctgtaatcccaacactttgggaggcagaggtggacagatcacttgagggcaggagttcgagaccagcctggccaacatggtgaaaccctgtttctactaaaaatacaaaaattagccaggcatgcctgtaatcccagctatttgggaagaggatgcatgaaaattgtttgaatcctggaaggcagaggttgcagtgagccaagattgcaccactgcactccagcc

SEQ ID NO: 373193 - DNA, 837 bp, Homo sapiens
tgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgtttcaggttttttgagatggagtctcgctctgttgcccagactagagtgcagtggcttgatctcggctcactgcaacctctgcctcctggattcaagtgattcttctgcctcagcctcctgaatagctggaattacaggtgcccaccaccacgcctggctactttttgtattttgagtacagatggggtttcaccgtattggccaggctggtctcaaactcctgacctcagatgatccacccacctcagcctcccaaagtgctgggattacaggcgtgagccaccacacctggtccatttttagcttcagcatctctactagttctttccccttgcatataaatacttaagg

SEQ ID NO: 373194 - DNA, 2984 bp, Homo sapiens
tgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttttcttataatgggggccaaccaatatttgtcactatacttcatttgaaaaaatgtaagaaatctgaaattacttagaactgatttctcaggtactggtctataagcaaaattaatgctgtgagtagttttctaaaa

SEQ ID NO: 373195 - DNA, 3681 bp, Homo sapiens
catggatcaaggccgggggtgaatcggcaccgaggcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaaaaaaaaaaaaaaagaaaggaacagcgagcaccaacacctagccactgcaagtaggaagcgcagggacgccgcgtagaatgaaacacacgagacaggagacgccgcagcaagccgccagaccacaccacaagaggcaccgccagccgagtaaacaaagtaaatggagacgcggcccggccccagtgggagaaagaaccaaacagggagcgcgggacaaccacactggtgaggacggggcaaacaccaacggaacgccacaacgcaatgtcgggagtcccacgcggcgaagcacgccctagaac

SEQ ID NO: 373196 - DNA, 2506 bp, Homo sapiens
tgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaggggccgctaaattacctcggggcagttcgctaccgtttttttcacggggctttggggggttaagaagacagcgggtaaaagccgaggacatggctggtcttgggaccactctcggtggcagggccccactaagccgcgcaaatattattgaaagttggattttttatccaataaaaaaaggaacgaatatgactaaaaagaacct

SEQ ID NO: 373197 - DNA, 4256 bp, Homo sapiens
tgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacggtctcgctgtgtcacacaggctggagtgcagtggcgtgagctcggctgactgcaaactctgcctcccaggtttaagcgattctcctgtcacagcttcccaagtagctgggatttacaggtgtgcaccgccatgccaggctaatttttgtgtttttagtagagacagggtttcgccaagttgtccaggctggtcttgaactcctgggctcaagtgatccgcccgcctcagtctcccaaagtgcgaggatgacatgtgtgagctaccacaccagcaatgtctatgcttctcgatagctgtgaacatgaaaagacatctattgggagtccgaggcaggtggattgcttgaggccaggagttagagaccagcctggccaacaaggcaaaaccccgtctctactaaaaatatgaaaattagctgggcttggtggctcatgcctataatcctagctacttgggaggctgaggcacgagacttgcttaatacctgggaggcggagattgcagtgagccgagatcacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaaaaaaaaaaaaaaagaaaggaacagcgagcaccaacacctagccactgcaagtaggaagcgcagggacgccgcgtagaatgaaacacacgagacaggagacgccgcagcaagccgccagaccacaccacaagaggcaccgccagccgagtaaacaaagtaaatggagacgcggcccggccccagtgggagaaagaaccaaacagggagcgcgggacaaccacactggtgaggacggggcaaacaccaacggaacgccacaacgcaatgtcgggagtcccacgcggcgaagcacgccctagaac

SEQ ID NO: 373198 - DNA, 3832 bp, Homo sapiens
tgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagtagagacggggtttcacgatgttggccaggctgttctcaaactcctgacatcaagtgatccatccgacttgacctcccaaagcactgagatgacagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaaaaaaaaaaaaaaagaaaggaacagcgagcaccaacacctagccactgcaagtaggaagcgcagggacgccgcgtagaatgaaacacacgagacaggagacgccgcagcaagccgccagaccacaccacaagaggcaccgccagccgagtaaacaaagtaaatggagacgcggcccggccccagtgggagaaagaaccaaacagggagcgcgggacaaccacactggtgaggacggggcaaacaccaacggaacgccacaacgcaatgtcgggagtcccacgcggcgaagcacgccctagaac

SEQ ID NO: 373199 - DNA, 3362 bp, Homo sapiens
tgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacggtctcgctgtgtcacacaggctggagtgcagtggcgtgagctcggctgactgcaaactctgcctcccaggtttaagcgattctcctgtcacagtacacaggaggctgaggcacgagaatcacttgaactcaggagatggaggtttcagtgagccaagatcacaccactgcactccagcctggcaacagagcgagactccatctcaaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaaaaaaaaaaaaaaagaaaggaacagcgagcaccaacacctagccactgcaagtaggaagcgcagggacgccgcgtagaatgaaacacacgagacaggagacgccgcagcaagccgccagaccacaccacaagaggcaccgccagccgagtaaacaaagtaaatggagacgcggcccggccccagtgggagaaagaaccaaacagggagcgcgggacaaccacactggtgaggacggggcaaacaccaacggaacgccacaacgcaatgtcgggagtcccacgcggcgaagcacgccctagaac

SEQ ID NO: 373200 - DNA, 3699 bp, Homo sapiens
tgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatctcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacggtctcgctgtgtcacacaggctggagtgcagtggcgtgagctcggctgactgcaaactctgcctcccaggtttaagcgattctcctgtcacagcttcccaagtagctgggatttacaggtgtgcaccgccatgccaggctaatttttgtgtttttagtagagacagggtttcgccaagttgtccaggctggtcttgaactcctgggctcaagtgatccgcccgcctcagtctcccaaagtgcgaggatgacatgtgtgagctaccacaccagcaatgtctatgcttctcgatagctgtgaacatgaaaagacatctattgggagtccgaggcaggtggattgcttgaggccaggagttagagaccagcctggccaacaaggcaaaaccccgtctctactaaaaatatgaaaattagctgggcttggtggctcatgcctataatcctagctacttgggaggctgaggcacgagacttgcttaatacctgggaggcggagattgcagtgagccgagatcacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaaaaaaaaaaaaaaagaaaggaacagcgagcaccaacacctagccactgcaagtaggaagcgcagggacgccgcgtagaatgaaacacacgagacaggagacgccgcagcaagccgccagaccacaccacaagaggcaccgccagccgagtaaacaaagtaaatggagacgcggcccggccccagtgggagaaagaaccaaacagggagcgcgggacaaccacactggtgaggacggggcaaacaccaacggaacgccacaacgcaatgtcgggagtcccacgcggcgaagcacgccctagaac

SEQ ID NO: 373201 - DNA, 1011 bp, Homo sapiens
tgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttggtgagtgaatttcagaagacaaaaaattatttgaataaaattcctaatagtgtatttttaggtaagcttttatttatgtgagaagtagcattttatttcttacctgaggaaaatagttttatatattttaattttctgtcttaaaatcagtttgtttcattcattatctcataaggatggccagaacttcaaggaactgattgtacctgccttttattcaacctaaatgacagactgtcatctc

SEQ ID NO: 373202 - DNA, 3683 bp, Homo sapiens
tgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaaaaaaaaaaaaaaagaaaggaacagcgagcaccaacacctagccactgcaagtaggaagcgcagggacgccgcgtagaatgaaacacacgagacaggagacgccgcagcaagccgccagaccacaccacaagaggcaccgccagccgagtaaacaaagtaaatggagacgcggcccggccccagtgggagaaagaaccaaacagggagcgcgggacaaccacactggtgaggacggggcaaacaccaacggaacgccacaacgcaatgtcgggagtcccacgcggcgaagcacgccctagaac

SEQ ID NO: 373203 - DNA, 3736 bp, Homo sapiens
tgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaaaaaaaaaaaaaaagaaaggaacagcgagcaccaacacctagccactgcaagtaggaagcgcagggacgccgcgtagaatgaaacacacgagacaggagacgccgcagcaagccgccagaccacaccacaagaggcaccgccagccgagtaaacaaagtaaatggagacgcggcccggccccagtgggagaaagaaccaaacagggagcgcgggacaaccacactggtgaggacggggcaaacaccaacggaacgccacaacgcaatgtcgggagtcccacgcggcgaagcacgccctagaac

SEQ ID NO: 373204 - DNA, 3625 bp, Homo sapiens
tgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaaagtaagaaagaaaaggactcccttagaatgggaaagatgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaaaaaaaaaaaaaaagaaaggaacagcgagcaccaacacctagccactgcaagtaggaagcgcagggacgccgcgtagaatgaaacacacgagacaggagacgccgcagcaagccgccagaccacaccacaagaggcaccgccagccgagtaaacaaagtaaatggagacgcggcccggccccagtgggagaaagaaccaaacagggagcgcgggacaaccacactggtgaggacggggcaaacaccaacggaacgccacaacgcaatgtcgggagtcccacgcggcgaagcacgccctagaac

SEQ ID NO: 373205 - DNA, 2362 bp, Homo sapiens
tgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaaattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaaaaaaaaaaaaaaagaaaggaacagcgagcaccaacacctagccactgcaagtaggaagcgcagggacgccgcgtagaatgaaacacacgagacaggagacgccgcagcaagccgccagaccacaccacaagaggcaccgccagccgagtaaacaaagtaaatggagacgcggcccggccccagtgggagaaagaaccaaacagggagcgcgggacaaccacactggtgaggacggggcaaacaccaacggaacgccacaacgcaatgtcgggagtcccacgcggcgaagcacgccctagaac

SEQ ID NO: 373206 - DNA, 1772 bp, Homo sapiens
tgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaatgcactccagcctggcaacagagcgagactccatctcaaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaaaaaaaaaaaaaaagaaaggaacagcgagcaccaacacctagccactgcaagtaggaagcgcagggacgccgcgtagaatgaaacacacgagacaggagacgccgcagcaagccgccagaccacaccacaagaggcaccgccagccgagtaaacaaagtaaatggagacgcggcccggccccagtgggagaaagaaccaaacagggagcgcgggacaaccacactggtgaggacggggcaaacaccaacggaacgccacaacgcaatgtcgggagtcccacgcggcgaagcacgccctagaac

SEQ ID NO: 373207 - DNA, 913 bp, Homo sapiens
cggccagagactgaacatccccttggttttatttctgctctcagactgaggaccatttagatctggtaagtgaggctgtgagctctttgctgtggctttgaattctgggtattgctctgcggtcccccagcatgaagtacgtgtgcgtccttggcctctcgcctgtgcgtgaactgttgctgtttctttgcttagttgccaggagctgtgcttaggtgccaagtgggattcaaaggtgaatggggtgggggtgagaggtcagacgtgtgtgtgtgtgcctgtgtgtacatgaatgtctgcatgtggtattatgttcattcagacacacctttctctgtatgtacgtgtgcgagggggagtgggccagcccagggctcagaggtcccaccctgatgcctggactaggccctggactagggggctggatcccactagtcctctgactccactcaggcccacactgcattcttgggatccaggacaggatccttcttaggagggaggtcagctggaaggagaagctggtgtttcaggggaagccaaggcccaggcccaggctggacttgtccttcttggtggcagcttcccacctcccctgtctccctgtgctccctcctgaacttaagtccatgacacgggcactcagaggcatgcacagctgctcattttcctcctctgtctcacacacttacatactcacccccagccaggagtggggcgggggctcctccctccctaactccctgacgggaggccagagaggctggaaaaggcaggcaggctttggcggccaacacggcggcagtttcggccccagcatggagttggaataaacaagtgactcagcggcagatggagctgacagccccacacacgtgtgtgcatacgcgcaggcacacgccacgccaggccc

SEQ ID NO: 373208 - DNA, 559 bp, Homo sapiens
  misc_feature (552)..(552): n is a, c, g, or t
aggttgctgttgctcaacccagcaccgtacgtatgagcagactcataggatcaccaaccatgtgccgcacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggagcggcacatgggttgggggatccaaagagtctgctgctgcgtacggcagtaagttgagaaagcngataccg

SEQ ID NO: 373209 - DNA, 562 bp, Homo sapiens
gatggatggagagtgggctccagagagacaggggatggacgatgtctcccttccctcactctgcactgggaggctgggcgagtgttggtgctggggccacagggccagtacacgtgccttcatctttgcacgtgtgttggtgtcagtgaatctgtgtgtgcatgtttccctccatggatctgagtgtctctgtgaatgcaccaacgtgtgtttgtatatctgtgggggcctccgtgctaaggcaccccgccttggctttgggattcaggaaccccaccttggccttgggatggagggccaacataaagctgcccacctgtcagccacctcctgacggacagttttctcctacagaacaatgcccagcgccttggggtctcccagtctactcattcgctcaccaccccagtggtttctgtggcaacgccgagtttactcagccagggcctccccttctcttccatgcccactgcctacaacacaggtgagtgttcatgtgacatgtgcatgtgtgcacttgggcttggggcaggcaagtgaccagacaaggtagaccgaggta

SEQ ID NO: 373210 - DNA, 5954 bp, Homo sapiens
agctgtgcctacgtcggcctcgactcccgggggctggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373211 - DNA, 5923 bp, Homo sapiens
agcaggctgtactggcccgagggcttagatggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373212 - DNA, 5054 bp, Homo sapiens
agctgtgcctacgtcggcctcgactcccgggggctggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373213 - DNA, 4894 bp, Homo sapiens
tctgtgatactctcagccatccttgcctgtatgctaagccactgtgtcaagaaggacttgccagtaaggaaacgccttgtccccttgtttcagagcattcatgtggctggggaacctgggctatttccagcctgggcaatagagtgagactccatctcaaaaaaacaaaacaaaaccaaaaccacatcttttcatcctgttaaaacacagcacctcatggttattatgacttaggtttctttaactctgagtaccgtcttcactgaatttttgtggtcttcttgaattccttacatctgtcattacacactccctgtcccctcatccccacagtcctcctggaggcagctccctcataggagcctgtgtgctctccccaactccaggttcatcctcacttttcctccatgcagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373214 - DNA, 4707 bp, Homo sapiens
agcaggctgtactggcccgagggcttagatggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373215 - DNA, 4103 bp, Homo sapiens
agctgtgcctacgtcggcctcgactcccgggggctggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttctgtgtgtgagcttcgtggtgatggggccgtgtagcgggtgctgttctgtgtctgagcttcgtggtgatggggccgtgtagcgggtgctgttctgtgtctgagcttcgtggtgatggggccgtgtagcgggtgctgttctgtgtctgagcttcgtgatcgtggggttgtaa

SEQ ID NO: 373216 - DNA, 3597 bp, Homo sapiens
aggttgctgttgctcaacccagcaccgtacgtatgagcagactcataggatcaccaaccatgtgccgcacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373217 - DNA, 4377 bp, Homo sapiens
agctgtgcctacgtcggcctcgactcccgggggctggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373218 - DNA, 3111 bp, Homo sapiens
  misc_feature (1)..(1): n is a, c, g, or t
nccgggctgcatgaattcggcaccagagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373219 - DNA, 3203 bp, Homo sapiens
tacttgagtaaggggacgggcttcctttcatgtggtggccgttcggccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373220 - DNA, 2835 bp, Homo sapiens
  misc_feature (1)..(2): n is a, c, g, or t
nnggggttccccccgggtttaaaaaggaaaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373221 - DNA, 2670 bp, Homo sapiens
agctaggtacgaggcggtgtaatcggagaggatgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373222 - DNA, 1167 bp, Homo sapiens
  misc_feature (11)..(11): n is a, c, g, or t
ggatcttgtcntagccgcgccagtgagagaaatgagagaaatgactgctccagcagcagagtctgcccttctgccactgtgctttctttggggacattcctctgctctagtgtcacctatgaggaaaccctgtgctgtggggatggtgggggagggagaatcaggttagaggacctgggtcagtactggctgcaaaagcccttggttttgaccaggaagaggggtcaaaggtaccggagagccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373223 - DNA, 1071 bp, Homo sapiens
agctgtgcctacgtcggcctcgactcccgggggctggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgaggtgggcccatacacacaggcaccaggatatacccccgcctgcatccacatggacacgtgcccacgttgcatgtacacgcagacctgcctatgcacacacactggtatacatgccccttgtagcccctcacctgtgcgcacacacatgcaaaccctccttctgtcatacaaacccagggtctgaggaggaaggaagggcagttcaagtgaacaggccagtgccaggctgccagcccacacccaccctgccctcacaggcagggtgcctgccaccaagcagtcagacagggggtaaccaagagctcccagccagaaaaacatggggcagggagccaaacaaaagcact

SEQ ID NO: 373224 - DNA, 205 bp, Homo sapiens
ggtgacctgaacagtgctaacggagcctgccccagccctgttggtgagtgcagtcatccttctacctggaggtggggaggggtgcccgctcagtggcctcagggggtccaaggatcaggaacgacctagatgagaggagaggaagatcccagggccaggactggatgaagagtcagtcagagatttttaagcccctggattttgt

SEQ ID NO: 373225 - DNA, 660 bp, Homo sapiens
gaactgctgaaggggaaggcagcgaggtgggggtgagctctctctgcagcaggccagatgggtggagactgcaagtgaaatgatgtccctacccgtggtgcaagcctttaacagccgtgtgtgaatttgagtctgttatcagggcctctaacctgctccccgtgtgtcctgcctggctgaggactaacccacctccactagggggtgtccctggtcctgtctgcagtgagcagagccttgttctcattctgtgggccagaaatggacccagagtatggacccagagtttctccccaaagttcttccttggtgggactggcaggcaggactccacaagggcacagggcagggagcttgaactgctggccctaggatgcgtagcccagaaatgagaagaacccttgcctgccctcccaggaaaagtggactccatggaaggggtcaacctggcctgatcctgcccctccatctttctgtctagtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtc

SEQ ID NO: 373226 - DNA, 5933 bp, Homo sapiens
agctgtgcctacgtcggcctcgactcccgggggctggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373227 - DNA, 5528 bp, Homo sapiens
agctgtgcctacgtcggcctcgactcccgggggctggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373228 - DNA, 5856 bp, Homo sapiens
agctgtgcctacgtcggcctcgactcccgggggctggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373229 - DNA, 5633 bp, Homo sapiens
agctgtgcctacgtcggcctcgactcccgggggctggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtatagtgaacacaacagacctagaaatgtagcaataacctactgaggacctttcatttactgatcatctggtgtgactgcggccctgcctggagggtactacgttttgagatttacagcaatgcattctgtagacagaaccagcaaaacaggcatttttaaattttt

SEQ ID NO: 373230 - DNA, 4965 bp, Homo sapiens
gatggatggagagtgggctccagagagacaggggatggacgatgtctcccttccctcactctgcactgggaggctgggcgagtgttggtgctggggccacagggccagtacacgtgccttcatctttgcacgtgtgttggtgtcagtgaatctgtgtgtgcatgtttccctccatggatctgagtgtctctgtgaatgcaccaacgtgtgtttgtatatctgtgggggcctccgtgctaaggcaccccgccttggctttgggattcaggaaccccaccttggccttgggatggagggccaacataaagctgcccacctgtcagccacctcctgacggacagttttctcctacagaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 373231 - DNA, 2531 bp, Homo sapiens
agctgtgcctacgtcggcctcgactcccgggggctggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggttacctcttacctctttaatatatgctcgcttattttcttccatcctctttcctctttctatcttgaggttttcttcattatttttacttactctttatttctctttcctattgtctatctcaccgtttactatattctcttcctttcttcattattttccacgttctc

SEQ ID NO: 373232 - DNA, 2191 bp, Homo sapiens
agctgtgcctacgtcggcctcgactcccgggggctggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgactgaggaccatttagatctggtaagtgaggctgtgagctctttgctgtggctttgaattctgggtattgctctgcggtcccccagcatgaagtacgtgtgcgtccttggcctctcgcctgtgcgtgaactgttgctgtttctttgcttagttgccaggagctgtgcttaggtgccaagtgggattcaaaggtgaatggggtgggggtgagaggtcagacgtgtgtgtgtgtgcctgtgtgtacatgaatgtctgcatgtggtattatgttcattcagacacacctttctctgtatgtacgtgtgcgagggggagtgggccagcccagggctcagaggtcccaccctgatgcctggactaggccctggactagggggctggatcccactagtcctctgactccactcaggcccacactgcattcttgggatccaggacaggatccttcttaggagggaggtcagctggaaggagaagctggtgtttcaggggaagccaaggcccaggcccaggctggacttgtccttcttggtggcagcttcccacctcccctgtctccctgtgctccctcctgaacttaagtccatgacacgggcactcagaggcatgcacagctgctcattttcctcctctgtctcacacacttacatactcacccccagccaggagtggggcgggggctcctccctccctaactccctgacgggaggccagagaggctggaaaaggcaggcaggctttggcggccaacacggcggcagtttcggccccagcatggagttggaataaacaagtgactcagcggcagatggagctgacagccccacacacgtgtgtgcatacgcgcaggcacacgccacgccaggccc

SEQ ID NO: 373233 - DNA, 1405 bp, Homo sapiens
agctgtgcctacgtcggcctcgactcccgggggctggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttggtaagtgggtgtctgggccaagggtgggggctggggaatggaagagtagggacaggggaaagagcagacctctagcaggagag

SEQ ID NO: 373234 - DNA, 706 bp, Homo sapiens
cagcagtcattttctagactgaaataatgtcttcctgaaagcggacagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgaggtgggcccatacacacaggcaccaggatatacccccgcctgcatccacatggacacgtgcccacgttgcatgtacacgcagacctgcctatgcacacacactggtatacatgccccttgtagcccctcacctgtgcgcacacacatgcaaaccctccttctgtcatacaaacccagggtctgaggaggaaggaagggcagttcaagtgaacaggccagtgccaggctgccagcccacacccaccctgccctcacaggcagggtgcctgccaccaagcagtcagacagggggtaaccaagagctcccagccagaaaaacatggggcagggagccaaacaaaagcact

SEQ ID NO: 373235 - DNA, 2533 bp, Homo sapiens
acagcctgtccctgcgctgcgcctccaggctggaccagcggagttccaggcggcatggaggggccccggagctccacccatgtccccttggtgctgccgcttcttgtacttctgctgctggccccggctaggcaggccgccgcccagcgctgcccacaggcctgcatctgtgacaactccaggcgacacgttgcctgccggtaccagaacctcactgaggtgccagacgccatccctgagctgacccagcggctggacctgcagggcaatttgctgaaggtgatccccgcagccgccttccagggcgtgcctcacctcacacacctggacctgcgccactgcgaggtggagctggtggccgagggcgccttccgtggcctgggccgcctgctcctgctcaacctggcctccaaccacctgcgtgagctgccccaggaggcgctggacgggctgggctcgttgcggcggctggagctggaggggaacgcactggaggagctgcggccggggacgttcggggcactgggtgcgctggccacgctaaacctggcccacaacgccctggtttacctgcccgccatggccttccaggggctactgcgcgtccgctggctgcggctgtcgcacaacgcgctcagcgtgctggcccccgaggccctggctggcctgcccgccctgagacggctcagcctacaccacaacgagctccaggctctgcccgggcctgtcttgtcccaggcccgcggcctggcccgtctggagctgggccacaacccgctcacctacgcgggcgaggaggacgggctggcgctgcccggcctgcgggagctgctgctggacggcggggccctgcaggccctgggtcccagggccttcgcacactgtccgcgcctgcacaccctcgacctccgcgggaaccagctagacaccctgcccccgctgcagggcccgggccagctgcgccggctgcggctgcaggggaatccgctgtggtgcggctgccaggcgcggcccctactcgagtggctggcgcgggcgcgcgtgcgctcggacggcgcgtgccagggccgcggcgcctgcggggcgaggctctggacgccctgcggccctgggacctgcgctgccctggggacgcggcgcaggaagaggaagagctggaagagcgggctgtggccgggccccgcgcccctccgcgcggccctccgcgcggccccggggaggagcgggcagtcgcgccttgccctcgcgcctgcgtgtgcgtccccgagtcccggcacagcagctgcgagggctgcggcctgcaggcggtgccccgcggcttccccagcgacacccagctcctggacctgaggcggaaccacttcccctcggtgccccgagcggccttccccggcctgggccacctggtgtcgctgcacctgcagcactgcggcatcgcggagctggaagcgggcgccctggccgggctgggccgcctgatctacctgtacctctccgacaaccagctcgcaggcctcagcgctgctgcccttgaaggggctccccgcctcggctacctgtacctagaacgcaaccgtttcctgcaggtgccaggggctgccctgcgcgccctgcccagcctcttctccctgcacctgcaggacaacgctgtggaccgcctggcacctggggacctggggagaacacgggccttgcgctgggtctacctgagtggaaaccgcatcaccgaagtgtcccttggggcgctgggcccagctcgggagctggagaagctgcacctggacaggaatcagctgcgagaggtgcccactggggccttggaggggctgcctgccctcctggagctgcagctctcgggcaacccactcagggccttgcgtgacggagccttccagcctgtgggcaggtcgctgcagcacctcttcctgaacagcagtggcctggagcagatttgtcctggggccttttcaggcctggggcccgggctccagagcctgcacctgcagaagaaccagcttcgggccctgcctgccctgcccagtctcagccagctggagctcatcgacctcagcagcaatcccttccactgtgactgccagctgcttccgctgcacaggtggcttactgggctgaacctgcgggtgggggccacctgcgccacccctcccaatgcccgtggccagagggtgaaggctgcagctgctgtctttgaagactgcccgggctgggctgccagaaaggccaagcggacaccagcctccaggcccagtgccaggagaacccccatcaaaggaagacagtgtggagcagataaggtggggaaggagaagggtcgtctctgagcacggagcaggctggtcctgccttgacccagcccggtggctcttactctcgccaggaacaggctccgacgagatcttcctggcaccctgagggtcgtcctccagcaggggcttcttggacccctgtctgaggggtcgcgtcttagtgggcgggattcttttccctttgaataaaaatggattcaaaccca

SEQ ID NO: 373236 - DNA, 1012 bp, Homo sapiens
acagcctgtccctgcgctgcgcctccaggctggaccagcggagttccaggcggcatggaggggtgagtctttgggcccgatggtgcaaggggggattcagagcagctcagtggcctcaggacaacgctgtggaccgcctggcacctggggacctggggagaacacgggccttgcgctgggtctacctgagtggaaaccgcatcaccgaagtgtcccttggggcgctgggcccagctcgggagctggagaagctgcacctggacaggaatcagctgcgagaggtgcccactggggccttggaggggctgcctgccctcctggagctgcagctctcgggcaacccactcagggccttgcgtgacggagccttccagcctgtgggcaggtcgctgcagcacctcttcctgaacagcagtggcctggagcagatttgtcctggggccttttcaggcctggggcccgggctccagagcctgcacctgcagaagaaccagcttcgggccctgcctgccctgcccagtctcagccagctggagctcatcgacctcagcagcaatcccttccactgtgactgccagctgcttccgctgcacaggtggcttactgggctgaacctgcgggtgggggccacctgcgccacccctcccaatgcccgtggccagagggtgaaggctgcagctgctgtctttgaagactgcccgggctgggctgccagaaaggccaagcggacaccagcctccaggcccagtgccaggagaacccccatcaaaggaagacagtgtggagcagataaggtggggaaggagaagggtcgtctctgagcacggagcaggctggtcctgccttgacccagcccggtggctcttactctcgccaggaacaggctccgacgagatcttcctggcaccctgagggtcgtcctccagcaggggcttcttggacccctgtctgaggggtcgcgtcttagtgggcgggattcttttccctttgaataaaaatggattcaaaccca

SEQ ID NO: 373237 - DNA, 770 bp, Homo sapiens
ccctgggaacaagtccttggtccctggggcctggtgtcttgagtgagaggctgtaattaggaaaccacacgctcagggcagacagctcttggggactctgccgttagccccttccttacaaacacatcacctcatccctcggggcacttgatagcagacaagaagttccagaaaggcttacatttactaaaagtttatttcaaatctgcctccaagtccatgtgttctgaaaaggacagagggggccttggagtgcagccagatggaaggactttgaaggctgtccaagtgctgctttcagagtgcaccaagtttttattgtccctgactgtggctccctgcctgtttgtcaggcgggagcctggagcctgcacagggacagagctggtttcatccggcactccctagccctggacaccctccttgtctcgcctgccctcctgcaggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttg

SEQ ID NO: 373238 - DNA, 843 bp, Homo sapiens
ccctgggaacaagtccttggtccctggggcctggtgtcttgagtgagaggctgtaattaggaaaccacacgctcagggcagacagctcttggggactctgccgttagccccttccttacaaacacatcacctcatccctcggggcacttgatagcagacaagaagttccagaaaggcttacatttactaaaagtttatttcaaatctgcctccaagtccatgtgttctgaaaaggacagagggggccttggagtgcagccagatggaaggactttgaaggctgtccaagtgctgctttcagagtgcaccaagtttttattgtccctgactgtggctccctgcctgtttgtcaggcgggagcctggagcctgcacagggacagagctggtttcatccggcactccctagccctggacaccctccttgtctcgcctgccctcctgcaggccttcactctcccctgaggctgtcctggcccggactgtggggagcacctccaccccccggagcaggtgcacacccaggtaagcaggtccaggggctggggtgggcagggctagcttttggatcctgagtgtcactactctctcctcccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttg

SEQ ID NO: 373239 - DNA, 3254 bp, Homo sapiens
cgaggccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctgtccctttattgatgtcatccagggtcttaacgcccctgaggctgagccctgctgcagaacccagcgctcctggccttgggccagcagctgaagccccatgctgtgtggagcaaagaggtttcctgagcaggcacatcccccggtgggtacctggagctgttgggagtatggcactcaaggtggagggcaggcacggcccaggggtcccaggatctgaggccgctgagctccctgtgtcagtttcctggaagaagcagctgcagcccttgtgcctgtggccagctggtacaagacgggtccacgcccccttggtccttttgtcctgaatgccttactccatagtctctgggcagagggagccagggcgggcaagcttgtggctgctgggagggctggtatgcagggcagaaagatggagatcaggaagactggccacaggcctggtgggaggaacaggatagggtgaggaggctctgggctggcggcctggcaggacttgaactctcagagcaagacatgaccccagagtccctctctggtctaaccccacaggtcacagagggtaaagaggtcccaagagggaaaggtttccttccagctgacacagtaaaataggagcttggagggaaaaggcagggaaggaagttggagcgccacggcgtgggtggaagaggtcagtccacagggaagaacgggtgaacagggctcctgctgagacatctcatgagctggaagcatccaaggagccagccccttgcagacgagttgggaggaacacctggtgttgctaactctaggaggctgctgtgggcaggctggcatggcagctcagtcccggggacaggcgtggtgggcagcccagagcaggtcgggcacgacgccggcgtgcagctgcaggatggagcccacgctcagcaggtgcatgatctggtgggagttgccccagtagtcaaagcggccaggtccccagcgctcgggcagacgggctacatttaccagtcccccaagcagcgccagtgcgtccatgcgcaggtagcagggcagggagcctggagcccctgaacccagacccactccccgggccccaaataccagtaggcgggcagcagcctgccatccaaatg

SEQ ID NO: 373240 - DNA, 2624 bp, Homo sapiens
  misc_feature (2114)..(2114): n is a, c, g, or t
  misc_feature (2116)..(2116): n is a, c, g, or t
  misc_feature (2606)..(2606): n is a, c, g, or t
  misc_feature (2608)..(2608): n is a, c, g, or t
cgaggccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgcaaaaaaaanancaaaaaaaaaaaaaacacaaagacgaaaacaaaaaaaaaaacacacaaaacccaaacaaaaaagaaacacacagcagagggaccgagccagccagcaagcacacacacgcaaagaagaaaccgaaaaaagagagaagaagcgacgagggagacacagaacagacagacggaaagacagaaacgcgacacagcacagccaagcagaaggagaaaaacacagcaagaggagcgccgccacgcaggcggcgacacgacggaggggaggagacaaaaaagacgagaggatagcgcagccgagagaggatgagcgagagatagagtcgaggacaagggacggcggaagagacgggaggaactacaggggaagacacaggcgagagagagaagtcagggaaggggcggggtgaagagccggagaaaggagacagagaaacgagagcgaggagaggaagccgaaagacgcacactgtcgtgccgcgggtgcgggagnangaagaggggaggggga

SEQ ID NO: 373241 - DNA, 2088 bp, Homo sapiens
cgaggccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttg

SEQ ID NO: 373242 - DNA, 3123 bp, Homo sapiens
caggactcccgtgagggggaacggcccgtgaacgcgcgcggagctgctcgcgccccgcccagtcgcccggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctgtccctttattgatgtcatccagggtcttaacgcccctgaggctgagccctgctgcagaacccagcgctcctggccttgggccagcagctgaagccccatgctgtgtggagcaaagaggtttcctgagcaggcacatcccccggtgggtacctggagctgttgggagtatggcactcaaggtggagggcaggcacggcccaggggtcccaggatctgaggccgctgagctccctgtgtcagtttcctggaagaagcagctgcagcccttgtgcctgtggccagctggtacaagacgggtccacgcccccttggtccttttgtcctgaatgccttactccatagtctctgggcagagggagccagggcgggcaagcttgtggctgctgggagggctggtatgcagggcagaaagatggagatcaggaagactggccacaggcctggtgggaggaacaggatagggtgaggaggctctgggctggcggcctggcaggacttgaactctcagagcaagacatgaccccagagtccctctctggtctaaccccacaggtcacagagggtaaagaggtcccaagagggaaaggtttccttccagctgacacagtaaaataggagcttggagggaaaaggcagggaaggaagttggagcgccacggcgtgggtggaagaggtcagtccacagggaagaacgggtgaacagggctcctgctgagacatctcatgagctggaagcatccaaggagccagccccttgcagacgagttgggaggaacacctggtgttgctaactctaggaggctgctgtgggcaggctggcatggcagctcagtcccggggacaggcgtggtgggcagcccagagcaggtcgggcacgacgccggcgtgcagctgcaggatggagcccacgctcagcaggtgcatgatctggtgggagttgccccagtagtcaaagcggccaggtccccagcgctcgggcagacgggctacatttaccagtcccccaagcagcgccagtgcgtccatgcgcaggtagcagggcagggagcctggagcccctgaacccagacccactccccgggccccaaataccagtaggcgggcagcagcctgccatccaaatg

SEQ ID NO: 373243 - DNA, 3277 bp, Homo sapiens
cgaggccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagcccgtccactgctctgttcgccaggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctgtccctttattgatgtcatccagggtcttaacgcccctgaggctgagccctgctgcagaacccagcgctcctggccttgggccagcagctgaagccccatgctgtgtggagcaaagaggtttcctgagcaggcacatcccccggtgggtacctggagctgttgggagtatggcactcaaggtggagggcaggcacggcccaggggtcccaggatctgaggccgctgagctccctgtgtcagtttcctggaagaagcagctgcagcccttgtgcctgtggccagctggtacaagacgggtccacgcccccttggtccttttgtcctgaatgccttactccatagtctctgggcagagggagccagggcgggcaagcttgtggctgctgggagggctggtatgcagggcagaaagatggagatcaggaagactggccacaggcctggtgggaggaacaggatagggtgaggaggctctgggctggcggcctggcaggacttgaactctcagagcaagacatgaccccagagtccctctctggtctaaccccacaggtcacagagggtaaagaggtcccaagagggaaaggtttccttccagctgacacagtaaaataggagcttggagggaaaaggcagggaaggaagttggagcgccacggcgtgggtggaagaggtcagtccacagggaagaacgggtgaacagggctcctgctgagacatctcatgagctggaagcatccaaggagccagccccttgcagacgagttgggaggaacacctggtgttgctaactctaggaggctgctgtgggcaggctggcatggcagctcagtcccggggacaggcgtggtgggcagcccagagcaggtcgggcacgacgccggcgtgcagctgcaggatggagcccacgctcagcaggtgcatgatctggtgggagttgccccagtagtcaaagcggccaggtccccagcgctcgggcagacgggctacatttaccagtcccccaagcagcgccagtgcgtccatgcgcaggtagcagggcagggagcctggagcccctgaacccagacccactccccgggccccaaataccagtaggcgggcagcagcctgccatccaaatg

SEQ ID NO: 373244 - DNA, 3321 bp, Homo sapiens
cgaggccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccaggtgagcccagaccccgccgtgaggggcctcggcgtggccacctcgccgctcccctccgcctcgccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctgtccctttattgatgtcatccagggtcttaacgcccctgaggctgagccctgctgcagaacccagcgctcctggccttgggccagcagctgaagccccatgctgtgtggagcaaagaggtttcctgagcaggcacatcccccggtgggtacctggagctgttgggagtatggcactcaaggtggagggcaggcacggcccaggggtcccaggatctgaggccgctgagctccctgtgtcagtttcctggaagaagcagctgcagcccttgtgcctgtggccagctggtacaagacgggtccacgcccccttggtccttttgtcctgaatgccttactccatagtctctgggcagagggagccagggcgggcaagcttgtggctgctgggagggctggtatgcagggcagaaagatggagatcaggaagactggccacaggcctggtgggaggaacaggatagggtgaggaggctctgggctggcggcctggcaggacttgaactctcagagcaagacatgaccccagagtccctctctggtctaaccccacaggtcacagagggtaaagaggtcccaagagggaaaggtttccttccagctgacacagtaaaataggagcttggagggaaaaggcagggaaggaagttggagcgccacggcgtgggtggaagaggtcagtccacagggaagaacgggtgaacagggctcctgctgagacatctcatgagctggaagcatccaaggagccagccccttgcagacgagttgggaggaacacctggtgttgctaactctaggaggctgctgtgggcaggctggcatggcagctcagtcccggggacaggcgtggtgggcagcccagagcaggtcgggcacgacgccggcgtgcagctgcaggatggagcccacgctcagcaggtgcatgatctggtgggagttgccccagtagtcaaagcggccaggtccccagcgctcgggcagacgggctacatttaccagtcccccaagcagcgccagtgcgtccatgcgcaggtagcagggcagggagcctggagcccctgaacccagacccactccccgggccccaaataccagtaggcgggcagcagcctgccatccaaatg

SEQ ID NO: 373245 - DNA, 3047 bp, Homo sapiens
cgaggccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacgctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctgtccctttattgatgtcatccagggtcttaacgcccctgaggctgagccctgctgcagaacccagcgctcctggccttgggccagcagctgaagccccatgctgtgtggagcaaagaggtttcctgagcaggcacatcccccggtgggtacctggagctgttgggagtatggcactcaaggtggagggcaggcacggcccaggggtcccaggatctgaggccgctgagctccctgtgtcagtttcctggaagaagcagctgcagcccttgtgcctgtggccagctggtacaagacgggtccacgcccccttggtccttttgtcctgaatgccttactccatagtctctgggcagagggagccagggcgggcaagcttgtggctgctgggagggctggtatgcagggcagaaagatggagatcaggaagactggccacaggcctggtgggaggaacaggatagggtgaggaggctctgggctggcggcctggcaggacttgaactctcagagcaagacatgaccccagagtccctctctggtctaaccccacaggtcacagagggtaaagaggtcccaagagggaaaggtttccttccagctgacacagtaaaataggagcttggagggaaaaggcagggaaggaagttggagcgccacggcgtgggtggaagaggtcagtccacagggaagaacgggtgaacagggctcctgctgagacatctcatgagctggaagcatccaaggagccagccccttgcagacgagttgggaggaacacctggtgttgctaactctaggaggctgctgtgggcaggctggcatggcagctcagtcccggggacaggcgtggtgggcagcccagagcaggtcgggcacgacgccggcgtgcagctgcaggatggagcccacgctcagcaggtgcatgatctggtgggagttgccccagtagtcaaagcggccaggtccccagcgctcgggcagacgggctacatttaccagtcccccaagcagcgccagtgcgtccatgcgcaggtagcagggcagggagcctggagcccctgaacccagacccactccccgggccccaaataccagtaggcgggcagcagcctgccatccaaatg

SEQ ID NO: 373246 - DNA, 2005 bp, Homo sapiens
ccaagaggcagccctggactgggtctgtgtcccagggccaaccctgcccctttctgtccccatcccgtccctgccagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctgtccctttattgatgtcatccagggtcttaacgcccctgaggctgagccctgctgcagaacccagcgctcctggccttgggccagcagctgaagccccatgctgtgtggagcaaagaggtttcctgagcaggcacatcccccggtgggtacctggagctgttgggagtatggcactcaaggtggagggcaggcacggcccaggggtcccaggatctgaggccgctgagctccctgtgtcagtttcctggaagaagcagctgcagcccttgtgcctgtggccagctggtacaagacgggtccacgcccccttggtccttttgtcctgaatgccttactccatagtctctgggcagagggagccagggcgggcaagcttgtggctgctgggagggctggtatgcagggcagaaagatggagatcaggaagactggccacaggcctggtgggaggaacaggatagggtgaggaggctctgggctggcggcctggcaggacttgaactctcagagcaagacatgaccccagagtccctctctggtctaaccccacaggtcacagagggtaaagaggtcccaagagggaaaggtttccttccagctgacacagtaaaataggagcttggagggaaaaggcagggaaggaagttggagcgccacggcgtgggtggaagaggtcagtccacagggaagaacgggtgaacagggctcctgctgagacatctcatgagctggaagcatccaaggagccagccccttgcagacgagttgggaggaacacctggtgttgctaactctaggaggctgctgtgggcaggctggcatggcagctcagtcccggggacaggcgtggtgggcagcccagagcaggtcgggcacgacgccggcgtgcagctgcaggatggagcccacgctcagcaggtgcatgatctggtgggagttgccccagtagtcaaagcggccaggtccccagcgctcgggcagacgggctacatttaccagtcccccaagcagcgccagtgcgtccatgcgcaggtagcagggcagggagcctggagcccctgaacccagacccactccccgggccccaaataccagtaggcgggcagcagcctgccatccaaatg

SEQ ID NO: 373247 - DNA, 581 bp, Homo sapiens
acagtttccagtcatttatattttcttttagagaggagttttcccttgtatgagtcctgtatgaagacaattttgttaaaaagtacaaacaacattggcccccaggtcagctttctcacaggggagcccacttttcacaccacagcctgggctgcctgtgttgctctgcagctgctttttccacctcgtgacacatccaagaggtcccctggggtcagtgcaggtcggccctggctcctccgtcgctgggtctccacagacccagcccgagggatggaggtttgtctggttttgttattaccctgggcaggggtctgagacagatgccagctacaccaccgtgccccgtgtgtgaacccttaatggggtctgccaggttgtccccctatgtgattgtgccacttgtggctcaccctcactgtgtgcgtgggtaccacctcccttccaggtgcgctccaaggaggacggccggctctatgcggtaaagcgttccatgtcaccattccggggccccaaggaccgggcccgcaagttggccgaggtgggcagccacgagaaggtggggcagcacccatgctgcg

SEQ ID NO: 373248 - DNA, 397 bp, Homo sapiens
cgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacgtaagtcgtagggcagggacggtgggagaactgggttaagatgcacaggcccaggtccccgagtgtgccagggttgggcctggaggctgtgcttgtgaccagtgacctccaggatcccaacaccctggctcctgacttggagaaaccctgggctgggactctgaggtagttagagtcagaggaagagtctccacaa

SEQ ID NO: 373249 - DNA, 2009 bp, Homo sapiens
ccctgggaacaagtccttggtccctggggcctggtgtcttgagtgagaggctgtaattaggaaaccacacgctcagggcagacagctcttggggactctgccgttagccccttccttacaaacacatcacctcatccctcggggcacttgatagcagacaagaagttccagaaaggcttacatttactaaaagtttatttcaaatctgcctccaagtccatgtgttctgaaaaggacagagggggccttggagtgcagccagatggaaggactttgaaggctgtccaagtgctgctttcagagtgcaccaagtttttattgtccctgactgtggctccctgcctgtttgtcaggcgggagcctggagcctgcacagggacagagctggtttcatccggcactccctagccctggacaccctccttgtctcgcctgccctcctgcaggccttcactctcccctgaggctgtcctggcccggactgtggggagcacctccaccccccggagcaggtgcacacccaggtaagcaggtccaggggctggggtgggcagggctagcttttggatcctgagtgtcactactctctcctcccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctgtccctttattgatgtcatccagggtcttaacgcccctgaggctgagccctgctgcagaacccagcgctcctggccttgggccagcagctgaagccccatgctgtgtggagcaaagaggtttcctgagcaggcacatcccccggtgggtacctggagctgttgggagtatggcactcaaggtggagggcaggcacggcccaggggtcccaggatctgaggccgctgagctccctgtgtcagtttcctggaagaagcagctgcagcccttgtgcctgtggccagctggtacaagacgggtccacgcccccttggtccttttgtcctgaatgccttactccatagtctctgggcagagggagccagggcgggcaagcttgtggctgctgggagggctggtatgcagggcagaaagatggagatcaggaagactggccacaggcctggtgggaggaacaggatagggtgaggaggctctgggctggcggcctggcaggacttgaactctcagagcaagacatgaccccagagtccctctctggtctaaccccacaggtcacagagggtaaagaggtcccaagagggaaaggtttccttccagctgacacagtaaaataggagcttggagggaaaaggcagggaaggaagttggagcgccacggcgtgggtggaagaggtcagtccacagggaagaacgggtgaacagggctcctgctgagacatctcatgagctggaagcatccaaggagccagccccttgcagacgagttgggaggaacacctggtgttgctaactctaggaggctgctgtgggcaggctggcatggcagctcagtcccggggacaggcgtggtgggcagcccagagcaggtcgggcacgacgccggcgtgcagctgcaggatggagcccacgctcagcaggtgcatgatctggtgggagttgccccagtagtcaaagcggccaggtccccagcgctcgggcagacgggctacatttaccagtcccccaagcagcgccagtgcgtccatgcgcaggtagcagggcagggagcctggagcccctgaacccagacccactccccgggccccaaataccagtaggcgggcagcagcctgccatccaaatg

SEQ ID NO: 373250 - DNA, 2358 bp, Homo sapiens
cgaggccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctaaaagaagcacaccaaacaacggacaaaccaaaaggttttcggggcgaccggcacgcacaggaaaaagtcttctaaaccccatccgtcggggcgcccagcccgtgaagctagctcacctgccgaaccaggtgcccaggagaaccccggcagcaaaagtgtggaattccccaaataaaaaggccgcgaacccgagtgtttgggaaaccccaggggttcaggacatcggtctacaccgggccgggacgataatc

SEQ ID NO: 373251 - DNA, 3013 bp, Homo sapiens
gatatcgaattccggaattccccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctgtccctttattgatgtcatccagggtcttaacgcccctgaggctgagccctgctgcagaacccagcgctcctggccttgggccagcagctgaagccccatgctgtgtggagcaaagaggtttcctgagcaggcacatcccccggtgggtacctggagctgttgggagtatggcactcaaggtggagggcaggcacggcccaggggtcccaggatctgaggccgctgagctccctgtgtcagtttcctggaagaagcagctgcagcccttgtgcctgtggccagctggtacaagacgggtccacgcccccttggtccttttgtcctgaatgccttactccatagtctctgggcagagggagccagggcgggcaagcttgtggctgctgggagggctggtatgcagggcagaaagatggagatcaggaagactggccacaggcctggtgggaggaacaggatagggtgaggaggctctgggctggcggcctggcaggacttgaactctcagagcaagacatgaccccagagtccctctctggtctaaccccacaggtcacagagggtaaagaggtcccaagagggaaaggtttccttccagctgacacagtaaaataggagcttggagggaaaaggcagggaaggaagttggagcgccacggcgtgggtggaagaggtcagtccacagggaagaacgggtgaacagggctcctgctgagacatctcatgagctggaagcatccaaggagccagccccttgcagacgagttgggaggaacacctggtgttgctaactctaggaggctgctgtgggcaggctggcatggcagctcagtcccggggacaggcgtggtgggcagcccagagcaggtcgggcacgacgccggcgtgcagctgcaggatggagcccacgctcagcaggtgcatgatctggtgggagttgccccagtagtcaaagcggccaggtccccagcgctcgggcagacgggctacatttaccagtcccccaagcagcgccagtgcgtccatgcgcaggtagcagggcagggagcctggagcccctgaacccagacccactccccgggccccaaataccagtaggcgggcagcagcctgccatccaaatg

SEQ ID NO: 373252 - DNA, 3327 bp, Homo sapiens
cgaggccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccaggtaagcaggtccaggggctggggtgggcagggctagcttttggatcctgagtgtcactactctctcctcccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctgtccctttattgatgtcatccagggtcttaacgcccctgaggctgagccctgctgcagaacccagcgctcctggccttgggccagcagctgaagccccatgctgtgtggagcaaagaggtttcctgagcaggcacatcccccggtgggtacctggagctgttgggagtatggcactcaaggtggagggcaggcacggcccaggggtcccaggatctgaggccgctgagctccctgtgtcagtttcctggaagaagcagctgcagcccttgtgcctgtggccagctggtacaagacgggtccacgcccccttggtccttttgtcctgaatgccttactccatagtctctgggcagagggagccagggcgggcaagcttgtggctgctgggagggctggtatgcagggcagaaagatggagatcaggaagactggccacaggcctggtgggaggaacaggatagggtgaggaggctctgggctggcggcctggcaggacttgaactctcagagcaagacatgaccccagagtccctctctggtctaaccccacaggtcacagagggtaaagaggtcccaagagggaaaggtttccttccagctgacacagtaaaataggagcttggagggaaaaggcagggaaggaagttggagcgccacggcgtgggtggaagaggtcagtccacagggaagaacgggtgaacagggctcctgctgagacatctcatgagctggaagcatccaaggagccagccccttgcagacgagttgggaggaacacctggtgttgctaactctaggaggctgctgtgggcaggctggcatggcagctcagtcccggggacaggcgtggtgggcagcccagagcaggtcgggcacgacgccggcgtgcagctgcaggatggagcccacgctcagcaggtgcatgatctggtgggagttgccccagtagtcaaagcggccaggtccccagcgctcgggcagacgggctacatttaccagtcccccaagcagcgccagtgcgtccatgcgcaggtagcagggcagggagcctggagcccctgaacccagacccactccccgggccccaaataccagtaggcgggcagcagcctgccatccaaatg

SEQ ID NO: 373253 - DNA, 3094 bp, Homo sapiens
cgaggccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagaggggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctgtccctttattgatgtcatccagggtcttaacgcccctgaggctgagccctgctgcagaacccagcgctcctggccttgggccagcagctgaagccccatgctgtgtggagcaaagaggtttcctgagcaggcacatcccccggtgggtacctggagctgttgggagtatggcactcaaggtggagggcaggcacggcccaggggtcccaggatctgaggccgctgagctccctgtgtcagtttcctggaagaagcagctgcagcccttgtgcctgtggccagctggtacaagacgggtccacgcccccttggtccttttgtcctgaatgccttactccatagtctctgggcagagggagccagggcgggcaagcttgtggctgctgggagggctggtatgcagggcagaaagatggagatcaggaagactggccacaggcctggtgggaggaacaggatagggtgaggaggctctgggctggcggcctggcaggacttgaactctcagagcaagacatgaccccagagtccctctctggtctaaccccacaggtcacagagggtaaagaggtcccaagagggaaaggtttccttccagctgacacagtaaaataggagcttggagggaaaaggcagggaaggaagttggagcgccacggcgtgggtggaagaggtcagtccacagggaagaacgggtgaacagggctcctgctgagacatctcatgagctggaagcatccaaggagccagccccttgcagacgagttgggaggaacacctggtgttgctaactctaggaggctgctgtgggcaggctggcatggcagctcagtcccggggacaggcgtggtgggcagcccagagcaggtcgggcacgacgccggcgtgcagctgcaggatggagcccacgctcagcaggtgcatgatctggtgggagttgccccagtagtcaaagcggccaggtccccagcgctcgggcagacgggctacatttaccagtcccccaagcagcgccagtgcgtccatgcgcaggtagcagggcagggagcctggagcccctgaacccagacccactccccgggccccaaataccagtaggcgggcagcagcctgccatccaaatg

SEQ ID NO: 373254 - DNA, 2453 bp, Homo sapiens
ggcacgaggctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgatctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctgtccctttattgatgtcatccagggtcttaacgcccctgaggctgagccctgctgcagaacccagcgctcctggccttgggccagcagctgaagccccatgctgtgtggagcaaagaggtttcctgagcaggcacatcccccggtgggtacctggagctgttgggagtatggcactcaaggtggagggcaggcacggcccaggggtcccaggatctgaggccgctgagctccctgtgtcagtttcctggaagaagcagctgcagcccttgtgcctgtggccagctggtacaagacgggtccacgcccccttggtccttttgtcctgaatgccttactccatagtctctgggcagagggagccagggcgggcaagcttgtggctgctgggagggctggtatgcagggcagaaagatggagatcaggaagactggccacaggcctggtgggaggaacaggatagggtgaggaggctctgggctggcggcctggcaggacttgaactctcagagcaagacatgaccccagagtccctctctggtctaaccccacaggtcacagagggtaaagaggtcccaagagggaaaggtttccttccagctgacacagtaaaataggagcttggagggaaaaggcagggaaggaagttggagcgccacggcgtgggtggaagaggtcagtccacagggaagaacgggtgaacagggctcctgctgagacatctcatgagctggaagcatccaaggagccagccccttgcagacgagttgggaggaacacctggtgttgctaactctaggaggctgctgtgggcaggctggcatggcagctcagtcccggggacaggcgtggtgggcagcccagagcaggtcgggcacgacgccggcgtgcagctgcaggatggagcccacgctcagcaggtgcatgatctggtgggagttgccccagtagtcaaagcggccaggtccccagcgctcgggcagacgggctacatttaccagtcccccaagcagcgccagtgcgtccatgcgcaggtagcagggcagggagcctggagcccctgaacccagacccactccccgggccccaaataccagtaggcgggcagcagcctgccatccaaatg

SEQ ID NO: 373255 - DNA, 1936 bp, Homo sapiens
ccctgggaacaagtccttggtccctggggcctggtgtcttgagtgagaggctgtaattaggaaaccacacgctcagggcagacagctcttggggactctgccgttagccccttccttacaaacacatcacctcatccctcggggcacttgatagcagacaagaagttccagaaaggcttacatttactaaaagtttatttcaaatctgcctccaagtccatgtgttctgaaaaggacagagggggccttggagtgcagccagatggaaggactttgaaggctgtccaagtgctgctttcagagtgcaccaagtttttattgtccctgactgtggctccctgcctgtttgtcaggcgggagcctggagcctgcacagggacagagctggtttcatccggcactccctagccctggacaccctccttgtctcgcctgccctcctgcaggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctgtccctttattgatgtcatccagggtcttaacgcccctgaggctgagccctgctgcagaacccagcgctcctggccttgggccagcagctgaagccccatgctgtgtggagcaaagaggtttcctgagcaggcacatcccccggtgggtacctggagctgttgggagtatggcactcaaggtggagggcaggcacggcccaggggtcccaggatctgaggccgctgagctccctgtgtcagtttcctggaagaagcagctgcagcccttgtgcctgtggccagctggtacaagacgggtccacgcccccttggtccttttgtcctgaatgccttactccatagtctctgggcagagggagccagggcgggcaagcttgtggctgctgggagggctggtatgcagggcagaaagatggagatcaggaagactggccacaggcctggtgggaggaacaggatagggtgaggaggctctgggctggcggcctggcaggacttgaactctcagagcaagacatgaccccagagtccctctctggtctaaccccacaggtcacagagggtaaagaggtcccaagagggaaaggtttccttccagctgacacagtaaaataggagcttggagggaaaaggcagggaaggaagttggagcgccacggcgtgggtggaagaggtcagtccacagggaagaacgggtgaacagggctcctgctgagacatctcatgagctggaagcatccaaggagccagccccttgcagacgagttgggaggaacacctggtgttgctaactctaggaggctgctgtgggcaggctggcatggcagctcagtcccggggacaggcgtggtgggcagcccagagcaggtcgggcacgacgccggcgtgcagctgcaggatggagcccacgctcagcaggtgcatgatctggtgggagttgccccagtagtcaaagcggccaggtccccagcgctcgggcagacgggctacatttaccagtcccccaagcagcgccagtgcgtccatgcgcaggtagcagggcagggagcctggagcccctgaacccagacccactccccgggccccaaataccagtaggcgggcagcagcctgccatccaaatg

SEQ ID NO: 373256 - DNA, 250 bp, Homo sapiens
gatgtaaggtaggtaggtcactacttcagaaagggtagtctaataagggtctttctaaggaagtgacatttgagtagagatgtgaatgaggtaagggacttatgtggatacctcagggcagagccttccaggcagaagaaacagtaagtgtttggtatgctaggaagatggtgagaagacgattataggtataggagagtgaatgagggggtaagtaatcagtgatgccacctgagagggcatatcacag

SEQ ID NO: 373257 - DNA, 885 bp, Homo sapiens
ccagttcatttcgaagacatgaaagaattcacactggggagagaccctataagtgtaaactatgtgggaaaggcttcaggtcttccagttacattcaactacatgaaaggactcacactggagagaaaccctatggttgtcagcaatgtgggaaagcattatctgatctctcaagctttcgaagacacatgataacacatactggaaatggacctcataaatgtaagatatgtgggaaaggctttgattatcccagttcagtgcaaagacatgaaagaactcacactggagagaaaccctatgaatgcaaggaatgtggtaaagccttcagtcattcaagttacttacgaatacacgaaagagttcatactggagagaagccgtataaatgtaaggaatgtgggaaaccattccattgtcccagtgcctttcataaacatgaaaggacccacagtatggagaaaccctataagtgtaaagaatgtggggaagcatttcattgtatcagttcctttcataaacatgaaatgactcactagagaaaacccctatgagtgttgaacatgtgagaaagccttaagtactttcagcttcttacaaatacataagagactcacactgaaaaaagttgtatgaatataaaaatgtactaaaaccttccatttttttcagtaccttttgaaaacatgaccaaactcatacttcaaaaatatatatataatgaatgtgaggaatatgaaaaaactttctttgtctagcaaactttcaaaggtggttattataacatactagcaatggaccttactactgtaaggaatgtagaaatgcatttactagtcctaattcatttcagttacatgaaagatttcaaactgcagagaacca

SEQ ID NO: 373258 - DNA, 458 bp, Homo sapiens
gaacaccaaaagtacccaaggaaaggagtaatggtggcactgagtatttggaggtgggattcaaccagaatacgtgattgttaattggccctggactaaggttttattgcaagaaagggttctttagcttaaaagtgtttagaaatgatttcaatacaattagtgaaatgtctaaatgttcaacaaagatggcaagtgatgccagtcatccttttcaatgcctatggcagacattgctaattgaacacagaacttcctgtggcagattcagatttactctccatacagctctccatttagtcactaccgatcaatcagagtgttatgtgagtcaaaacccatttactatctataacaggggtatccaatcttttggcttccctgggccacattggaagaagaagaattgtcttgggccacacataaaatacactaacactaacgatagctgatgaact

SEQ ID NO: 373259 - DNA, 441 bp, Homo sapiens
gaaaccccatatctactaaaaatacaaacaattagcaggatgtggtggcaggtgcctgtaatcccagctacttgggaggctgaggcaggagaatcacttgaacccgggaagaggagcttgcagtgagccgagatcgcgccactgcactccagcctgggtgacagagcgagactcggtctcagaaaaaaaaaaaaaaaaacgactcaccaagtccataggcacctcagccttccctcattgcagtgagaaagcagatcttgctatgtttgtaacatgcagaggcaattttctgtcccttcaatttgaaggcaggatggcgttttctgcctttcacgtttcctccaggacgccccgactttacagacagcagaaattccagatacttttcttgtcgttaccattttgttggctgttgctggcgccttcctcctgtctgaaggg

SEQ ID NO: 373260 - DNA, 1437 bp, Homo sapiens
tccttgtacctattccatgagctacaaggaacatctgaggctctgaaacaagctcacacttttcccccaaatgagacgaggaagccccttgggtgagggaggagcagctcagactctgcttcctgctctgctccatgcttctctggtgactgggcctgcctcactcaacctggggtgggaccagcatgtgtggagaaagagtcctggtggcctgtcctgaatttggctaaatcgagctgccagttgaagccaagcctcccccgggccaggctgcagggaaataagaagagagggagccctcagggaagactcctgcgttgcgtcctggctctgaagtcaccggttgtatgaggttgtgggcacagcatgtgggacacagcacggaggatagtgactgatgcagagctggagaaatagagagattcacccctggggctctgcatggcaggaaaggggcagtgccaaaaagtgtgtaattatagagagggtaagactaccagacactttatatatatctaatataagacttaccattaactatttctatgtgtgcaatttagtgttgtgtaaccatcacactatccatttccagaactttttcctcttaccatattaaacctctgtacccaataaacagtaactcactccttctccccataacccttagcacacaccattctacattctgtctctatgtaactggctattctaactatcttttataaatggaattatatgataattatccttttgtgtctggtttatttcagttagcataatatcttcaaggttcatccattttgcatgatgtattggaattttattccttgttaaggttgaataacatttcaatgtatagatacacctcatttgcctacccacttatctttcaatggacttttcagttgtttccattttttcgctagtgtgagtaatgcttctctgaacatcagtgtacaaatatttgttcaaatttctttcaattctatggggagtatgtccagaagtggaattgctggatcaaatggtaatttattgtttaattttttgagaaacagccacaccactttttacagtggctataacatttcccattcccatcagcaatgcactagagctccaatttttccatctacttgaaaacacctgttgttttgtgttgttgtcattgttgttgtttatcaaagccatcctaaattgtgtgaggtggtgtagcattgtggttttgatttgcatatctctaagtattcgtgatgctgaggaactttgcatgggcttattggatatttgtatatcttccttggagaaaactccattttaatcctttgttcattttttaattgggtttttggatgtttgctgttgttgacttgtagcttttcatgtattctggaaattaatttcttatcacacatataatttgcaaatatttttatc

SEQ ID NO: 373261 - DNA, 967 bp, Homo sapiens
tgcaaatatttttatcatttcgtgggttgcctttttactttcttgataatgttcttcgacatataaaagctttgatttttgtgaagtccgatttatccattttatttgttgcctatgcttttgttgttacaaccaagaaatcattgggaaatccagtatcatgaagcttttcttctaagagttgtgtagtttttctcttacatttagatctttgatctattgtgggttaatttttgtacatggtgttaggtaaaggttccaatcttcttgcccttggatatccagctttcccaatatcctttggtgagaacactgtcccttccccattgtaaatgctgaaatcaggaagtgtgagtcctccagcttcattcttcctcttcaaagctgtgtgtctatttagagtcatgagatacaatataaattttaggacagatttttctttttctgcaaaaatgccactgagaatctgataggaattgtattgaatctgcagtcactttgggtagcactgttctcctaacaatattgagtcttccaattcatgaaaacaaaatgtctttcaatttattgatgtcatctttcatttctttcagcaatattttgtagatttcaggtataatcatttcacctctttgattaaacttattcctaaatattttattctttttgatgttaatataaattgaaatttttttcttaatttcccttcagattgttcatggttagtgtattgaaatacaacagatgtttgaatgttgattttgtattgtgcaacattactgaatttatttattaattctaattaggtttgttcaatctttaggattttctacatataagttcaagttatctataaacagaaataattttactccttccttccaatttgaatgtctttttttcaattcttgcctaatttttctgactagacctttcaatactacgttgaataaaagtgtcaaaagca

SEQ ID NO: 373262 - DNA, 415 bp, Homo sapiens
  misc_feature (13)..(13): n is a, c, g, or t
  misc_feature (27)..(27): n is a, c, g, or t
  misc_feature (58)..(58): n is a, c, g, or t
tggccagggaaanccccccaaaccccnggacagtcaaagtcctctggtcccccgcccngggagaccctgacagagtcctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373263 - DNA, 673 bp, Homo sapiens
tagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctatggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctccgtgagtatcctctgttcctctgtga

SEQ ID NO: 373264 - DNA, 2135 bp, Homo sapiens
aggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaaaaaaaaaaaaaaaaaaaaaaaaaaaaaaaaaagcgcgcacaaaacaaaaaaaaaaaaaaaaaaaaaaaaaagtgtggggggcgcagcaggggcgccaaggaaaaagtgtttataaaacacaagcctggatggagggacgacgcgcggacacaccaagagatgataagagcacaccgaacgggacaaacacgccgctcacacgaagaaaaaaggggaaaacgaaaaaaagagagggagaagcaactcgcccaacgaatagaaaaaacaccaccccggggggggacaaacaaggaagcgcaccgctgagaaacaaacaacaaaaacggagaagaccacccgaagcgagcacaacacagggaagacaataacaaagagagaggagagaaagagagacacgcagaacatcacaaaaagacccccacagcaccgcgaggaac

SEQ ID NO: 373265 - DNA, 2061 bp, Homo sapiens
aggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaaccaaaaaaaaacaaaaaaaaaaaaaaaaaactctgtgtgggcgcgcgcgccccgggcccccggagaaaagcttttcgagaacccttgcgggtggggcgcgcgcgcggggccccagtgaggtacagggcgaacacggggcgcacaaaagcgggttccccagaggaaacaccggggccaagagaaccagagggccggggaattcctcacacagaaaaaaaaaacgccgcgggggggaaaaaccgcgaacgcgtttcgtgggaaaaagatcccgaaagaggagggtctgcgggaggagcaaaaagagggggaacaccaccaccaagggagtctcagaggagagaaccagaatataaaaatagagcc

SEQ ID NO: 373266 - DNA, 2182 bp, Homo sapiens
  misc_feature (1723)..(1723): n is a, c, g, or t
  misc_feature (1764)..(1764): n is a, c, g, or t
aggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaaaaaaaaaacaaaaaacaaaaaaaanacaaacaaacaaaaaaaaaaaaaaacaaaaaaaagaaaaanaaaaaaaaaaattttttgggggggcgcggccctcataaaaaaatcttctttctagccaacacccattctcttgtgtggcggggcgcgcgcggccacccaatcgtgagagttagccgcaccagtggtggcacaacagggcgttcctctcggcaggggacaacctgcggcggccaccaagaactacacgcgcgtggaggtgcatctctctccccacccaaaaaatacaaaacatcgcgcgcgcggggggcgacacacaacaagtcgtcttttttaaagacaacaaaccacccaaactagttcgtcatgctcccgggcaccaccctctatcgtggcggtctcttattcctcccggagggtgccacccaaccgcagacgccccgctcctattcatattattatccccccccccatccatgga

SEQ ID NO: 373267 - DNA, 1629 bp, Homo sapiens
cctcagaactagcatggatagcctcgattctccttgctgctgtaagaagtcttcaattggacaggaattgtcctgctcacagcatcacttttaaacttctggaacccgcccaccactgccgaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373268 - DNA, 1546 bp, Homo sapiens
ctgtccgcccctctctgctgctccgcccctctctgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373269 - DNA, 2184 bp, Homo sapiens
  misc_feature (1725)..(1725): n is a, c, g, or t
  misc_feature (1766)..(1766): n is a, c, g, or t
aggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaaaaaaaaaacaaaaaacaaaaaaaanacaaacaaacaaaaaaaaaaaaaaacaaaaaaaagaaaaanaaaaaaaaaaattttttgggggggcgcggccctcataaaaaaatcttctttctagccaacacccattctcttgtgtggcggggcgcgcgcggccacccaatcgtgagagttagccgcaccagtggtggcacaacagggcgttcctctcggcaggggacaacctgcggcggccaccaagaactacacgcgcgtggaggtgcatctctctccccacccaaaaaatacaaaacatcgcgcgcgcggggggcgacacacaacaagtcgtcttttttaaagacaacaaaccacccaaactagttcgtcatgctcccgggcaccaccctctatcgtggcggtctcttattcctcccggagggtgccacccaaccgcagacgccccgctcctattcatattattatccccccccccatccatgga

SEQ ID NO: 373270 - DNA, 2532 bp, Homo sapiens
tacccgataacgacagaaggggagtagacgacagaagggttgaaggacagcacagcctgacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacccgcccaccactgccgaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaaggatgcaggatcctacaccttacacatcataaagcgaggtgatgaggactagaggagtaactggacatttcaccttcaccttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatgcttgctctgttcgtaactcagccactggcaaggaaagctccaaatccatgacagtcaaagtctctggtaagtggatcccagcatccttggcagtagggttttatgtggagtctatctggctttcagagaagagtcaggaaaacatttttattcccagcctgtgtcccatgggcacaagcaaatcccaaattctcctcctgaaccctcccaatttgtctctacagactctcttctccttgtttttctgttttcttatggctgaccttgtgtctggcctgaaaaaggtagggagggggctttatcagccctgagccctatgtggtagaagaggcttcagagagggacaagaaggagagtcctcaagatcaagttgcttctcgctgtcaccgacacatccccttctgccacgtcttttttttcttgtacctattccatgagctacaaggaacagctgaggctttgaaacaagctcacacttttcccccagatgagaggaggaagccccttgggtgagggaggagcagctcagactctgcttcctgctctgctccgggctcctctggtgactggccctgcctcactcaacctggggtgggactagcgtgtgtgtagaaagggccctggtggcctggtcctgaatttggctaaattgagctgccagttgaagccaagcctcccccgggccaggctgcagggaaataagaagagagggagcctcagggcagactcctgagctgcgtcctggctctgaagtcaccagctgtatgaggctttgggcacagcacgtgggacacagcacggaggacagtgactgatgcagagctggaggaatagggagattcaccgttggggttattcatggcaggaaaggggcagtgccaaaaagtgtgtaattatagagagggtaagactaccagacactttatatatatctaatataagacttaccattaactatttctatgtgtgcaatttagtgttgtgtaaccatcacactatccatttccagaactttttcctcttaccatattaaacctctgtacccaataaacagtaactctcactccttcttcccctaacccttagcacccatcattctactttgtctctatgtaactggctattctaactatcttttataaatggaattacaaaaaaacaaaaaaaaaaaaaaaaaaaaaaaattgtgtggggcgcgcgcctgtgggcccctgagagaaaggttttttgagagaaacaattgggtgtgtgggggcgggggaccccaagatagaggtaaacggcaaacgtgggcacaaaaggggtgttccatgagagaaaccggggacacgacacaagggcggggaatccacacagaaatagaaaagcggcccgcggggaaacgacgaagcgttctgggaaaaacatcccaagaaggagaatcgagagaggacatcggagggaaacaaacaaaggagagtccaagggagaccgaatacacattaagcccggcgcgggagat

SEQ ID NO: 373271 - DNA, 1741 bp, Homo sapiens
tacccgataacgacagaaggggagtagacgacagaagggttgaaggacagcacagcctgacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacccgcccaccactgccgaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373272 - DNA, 1545 bp, Homo sapiens
ctgtccgcccctctctgctgctccgcccctctctgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373273 - DNA, 1742 bp, Homo sapiens
tacccgataacgacagaaggggagtagacgacagaagggttgaaggacagcacagcctgacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacccgcccaccactgccgaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagtcgcagtgacccagtcaccctgaatctcctcccaaagctgcccaagccctacatcacaatcaacaacttaaacccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373274 - DNA, 1742 bp, Homo sapiens
tacccgataacgacagaaggggagtagacgacagaagggttgaaggacagcacagcctgacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacccgggaaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagtcgcagtgacccagtcaccctgaatctcctcccaaagctgcccaagccctacatcacaatcaacaacttaaacccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373275 - DNA, 1076 bp, Homo sapiens
aggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgtttcacggaccctatgcaatgtgaatatcgggaccgtagtatgtgccccccgtatttaccccggtcatcatataatc

SEQ ID NO: 373276 - DNA, 1463 bp, Homo sapiens
tacccgataacgacagaaggggagtagacgacagaagggttgaaggacagcacagcctgacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacccgcccaccactgccgaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctccatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373277 - DNA, 954 bp, Homo sapiens
tacccgataacgacagaaggggagtagacgacagaagggttgaaggacagcacagcctgacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacccgcccaccactgccgaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcctggtacaaaggacaactgatggacctctaccattacattacatcatatgtagtagacggtcaaataaatatatatgggcctgcatacactggacgagaaacagtatattcca

SEQ ID NO: 373278 - DNA, 387 bp, Homo sapiens
  misc_feature (19)..(19): n is a, c, g, or t
ctgtctagaggatcccagngtcatgtataccatgggagactgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373279 - DNA, 1698 bp, Homo sapiens
aggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373280 - DNA, 1185 bp, Homo sapiens
tacccgataacgacagaaggggagtagacgacagaagggttgaaggacagcacagcctgacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatactatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373281 - DNA, 2009 bp, Homo sapiens
  misc_feature (1755)..(1755): n is a, c, g, or t
  misc_feature (1796)..(1796): n is a, c, g, or t
aggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaaaaaaaaaaaaaaaaaaaaaaaaaaaaaaaaaaaaaaaaaacaaaaaacaaaaaaaanacaaacaaacaaaaaaaaaaaaaaacaaaaaaaagaaaaanaaaaaaaaaaaaaacaaaaaaaaaaaacaagaaagaaaaaaaaagagaacaaaaagacaccaagaacagcacacaacacagaaaggaggcgggcgggcgcgcgacggcgggaaagaaagacgaaaaaaagaccaagggggcgcgaggacagccgaccgcgagtgacacgagagcgacgagaaagagcggcgccccgaagacaggaggtcgagt

SEQ ID NO: 373282 - DNA, 1742 bp, Homo sapiens
tacccgataacgacagaaggggagtagacgacagaagggttgaaggacagcacagcctgacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacccgcccaccactgccgaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373283 - DNA, 1740 bp, Homo sapiens
  misc_feature (63)..(63): n is a, c, g, or t
ggaggggtgaaagtcaacggcgggtcttgtgacggcgttcagcagtagttgacggggagcganagctcagcttgagccggaacaaacacggaccagaagagtgtgcagttgcaagatttaataagagtgaaaacagagctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373284 - DNA, 2767 bp, Homo sapiens
aggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtaagtggatcccagcatccttggcagtagggttttatgtggagtctatctggctttcagagaagagtcaggaaaacatttttattcccagcctgtgtcccatgggcacaagcaaatcccaaattctcctcctgaaccctcccaatttgtctctacagactctcttctccttgtttttctgttttcttatggctgaccttgtgtctggcctgaaaaaggtagggagggggctttatcagccctgagccctatgtggtagaagaggcttcagagagggacaagaaggagagtcctcaagatcaagttgcttctcgctgtcaccgacacatccccttctgccacgtcttttttttcttgtacctattccatgagctacaaggaacagctgaggctttgaaacaagctcacacttttcccccagatgagaggaggaagccccttgggtgagggaggagcagctcagactctgcttcctgctctgctccgggctcctctggtgactggccctgcctcactcaacctggggtgggactagcgtgtgtgtagaaagggccctggtggcctggtcctgaatttggctaaattgagctgccagttgaagccaagcctcccccgggccaggctgcagggaaataagaagagagggagcctcagggcagactcctgagctgcgtcctggctctgaagtcaccagctgtatgaggctttgggcacagcacgtgggacacagcacggaggacagtgactgatgcagagctggaggaatagggagattcaccgttggggttattcatggcaggaaaggggcagtgccaaaaagtgtgtaattatagagagggtaagactaccagacactttatatatatctaatataagacttaccattaactatttctatgtgtgcaatttagtgttgtgtaaccatcacactatccatttccagaactttttcctcttaccatattaaacctctgtacccaataaacagtaactctcactccttcttcccctaacccttagcacccatcattctactttgtctctatgtaactggctattctaactatcttttataaatggaattacaaaaaaacaaaaaaaaaaaaaaaaaaaaaaaattgtgtggggcgcgcgcctgtgggcccctgagagaaaggttttttgagagaaacaattgggtgtgtgggggcgggggaccccaagatagaggtaaacggcaaacgtgggcacaaaaggggtgttccatgagagaaaccggggacacgacacaagggcggggaatccacacagaaatagaaaagcggcccgcggggaaacgacgaagcgttctgggaaaaacatcccaagaaggagaatcgagagaggacatcggagggaaacaaacaaaggagagtccaagggagaccgaatacacattaagcccggcgcgggagat

SEQ ID NO: 373285 - DNA, 2767 bp, Homo sapiens
aggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctctatcccccaaattactacaaagcatagagggctctatgcttgctctgttcgtaactcagccactggcaaggaaagctccaaatccatgacagtcaaagtctctggtaagtggatcccagcatccttggcagtagggttttatgtggagtctatctggctttcagagaagagtcaggaaaacatttttattcccagcctgtgtcccatgggcacaagcaaatcccaaattctcctcctgaaccctcccaatttgtctctacagactctcttctccttgtttttctgttttcttatggctgaccttgtgtctggcctgaaaaaggtagggagggggctttatcagccctgagccctatgtggtagaagaggcttcagagagggacaagaaggagagtcctcaagatcaagttgcttctcgctgtcaccgacacatccccttctgccacgtcttttttttcttgtacctattccatgagctacaaggaacagctgaggctttgaaacaagctcacacttttcccccagatgagaggaggaagccccttgggtgagggaggagcagctcagactctgcttcctgctctgctccgggctcctctggtgactggccctgcctcactcaacctggggtgggactagcgtgtgtgtagaaagggccctggtggcctggtcctgaatttggctaaattgagctgccagttgaagccaagcctcccccgggccaggctgcagggaaataagaagagagggagcctcagggcagactcctgagctgcgtcctggctctgaagtcaccagctgtatgaggctttgggcacagcacgtgggacacagcacggaggacagtgactgatgcagagctggaggaatagggagattcaccgttggggttattcatggcaggaaaggggcagtgccaaaaagtgtgtaattatagagagggtaagactaccagacactttatatatatctaatataagacttaccattaactatttctatgtgtgcaatttagtgttgtgtaaccatcacactatccatttccagaactttttcctcttaccatattaaacctctgtacccaataaacagtaactctcactccttcttcccctaacccttagcacccatcattctactttgtctctatgtaactggctattctaactatcttttataaatggaattacaaaaaaacaaaaaaaaaaaaaaaaaaaaaaaattgtgtggggcgcgcgcctgtgggcccctgagagaaaggttttttgagagaaacaattgggtgtgtgggggcgggggaccccaagatagaggtaaacggcaaacgtgggcacaaaaggggtgttccatgagagaaaccggggacacgacacaagggcggggaatccacacagaaatagaaaagcggcccgcggggaaacgacgaagcgttctgggaaaaacatcccaagaaggagaatcgagagaggacatcggagggaaacaaacaaaggagagtccaagggagaccgaatacacattaagcccggcgcgggagat

SEQ ID NO: 373286 - DNA, 1741 bp, Homo sapiens
tacccgataacgacagaaggggagtagacgacagaagggttgaaggacagcacagcctgacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacccgcccaccactgccgaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacccgggaaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373287 - DNA, 1699 bp, Homo sapiens
aggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggaggaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373288 - DNA, 1701 bp, Homo sapiens
aggacagcacagctgacagccgtgctcagacagcttctggatcctaggctcatctccacagaggagaacacgcaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggaggaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 373289 - DNA, 2001 bp, Homo sapiens
tacccgataacgacagaaggggagtagacgacagaagggttgaaggacagcacagcctgacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacccgcccaccactgccgaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctagtggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctccatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtaagtggatcccagcatccttggcagtagggttttatgtggagtctatctggctttcagagaagagtcaggaaaacatttttattcccagcctgtgtcccatgggcacaagcaaatcccaaattctcctcctgaaccctcccaatttgtctctacagactctcttctccttgtttttctgttttcttatggctgaccttgtgtctggcctgaaaaaggtagggagggggctttatcagccctgagccctatgtggtagaagaggcttcagagagggacaagaagggaattccaaggcagcgtccgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctgggaccccatggccttcagccctggctgagcaactgggctgtagggcagggcacttctgaggtcaggtcttggtaggtgcctgcatctgtctgccttctggctgacaatcctggaaatctgttctccagaatcaggccaaaaagttcacagtcaaatggggaggggtattcttcatgcaggagacccctaggccctggaggctgcaacatacctcaatcctgtcccaggccggatcctcctgaagcccttttcgcagcactgctatcctccaaagccattgtaaatgtgtgtacagtgtgtataaaccttcttcttctttttttttttttaaactgaggattgtcattaaacacagttgttttct

SEQ ID NO: 373290 - DNA, 867 bp, Homo sapiens
tacccgataacgacagaaggggagtagacgacagaagggttgaaggacagcacagcctgacagccgtgctcaggaagtttctggatcctaggctcagctccacagaggagaacacgcaggcagcagagaccatggggcccctctcagcccctccctgcacacagcacatcacctggaagggggtcctgctcacagcatcacttttaaacttctggaacccgcccaccactgccgaagtcacgattgaagcccagccacccaaagtttctgaggggaaggatgttcttctacttgtccacaatttgccccagaatcttgctggctacttctggtacaaagggcaaatgacggacctctaccattacattacatcatatgtagtagacggtcaaataattatatatgggcctgcatacagtggaagagaaacagtatattccaatgcatccctgctgatccagaatgtcacgccggaaggatgcaggaacctacaccttacacatcataaagcgaggtgatgagactagagaagaaattcgacatttcaccttcaccttatactttggagactcccaagccctacatctccagcagcaacttaaaccccagggaggccatggaggctgtgcgcttaatctgtgatcctgagactctggacgcaagctacctatggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctccgtgagtatcctctgttcctctgtga

SEQ ID NO: 373291 - DNA, 774 bp, Homo sapiens
tgtggttggttttttttggccacccctcccccaatctatctctaattttaagatgtgattcactaggaaaatatgattctgttaattgaattcattttagagccaacttttcaggaacctatctatttctgtaaagtgagagccacttgtaaatgtaccgtttggtgccagcactcaaattttccctgactcagttgctccagtggtgtttaaatatcttcccataaatcaggcagccagcgctccatacttatttactgggtcttgtgattcagcccaggatcctgatagtgatcttggatgggtgatataaatagactaggatttgccaatggctatttttatcagggaagctttctaagttgatttctttgaacccagaacaacttcctccctctggcttcccctgttttcctccaagactagggagatcctttctttattctgcccgcccatcttctgcccctcccccagccagctggtgtctgcagaaattagaaggaaggtacgtgcctgacacagagttgcctgaaatcatatatctttaccccctttcaggatcatctttctttcatccggcccaagaatggcaccttccccgcccatcaggccacctgcactcaggagtcggctgcctgtcctgaaatagatctctaccagctctcaagcagaacaattccttgcattcatacttgaatgtataatttgtgttattacctcttatttgtctttgtaagtttgtccctgccccagtttaaaaaaaaaaaaaaatct

SEQ ID NO: 373292 - DNA, 170 bp, Homo sapiens
atgactcctatgccgccgcttcctcttcccgcaggaggccgagcatgctcactgcgccgcgctgccgaggcagggagggcttctgcacaggatcagcctctcaatgtagcaagtgttggaaagaaagagaaaggggagggggagagactctagagacggggccttggcag

SEQ ID NO: 373293 - DNA, 6453 bp, Homo sapiens
  misc_feature (2803)..(2803): n is a, c, g, or t
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccnaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaagatagtaagtattaaggtttttgtttactgtctatataattaatagaaaccagctattttttctccattaaaacatgcatcacgtttaaagcactatggaatcctccaacctcagctctagtctaacaaactgcagtgttcagagaagataaaatgcccgtgattggtagagtctgcagtccagttgcaagcacctgaaatctagagagagaaagacctataacctgtatgagacttccccttccaaagctgtattgtctacattaaaaaaaacaaaaacagtaacaacaacaaacacacaaatggtcagaaatgtcatccttaaaccctttgtttttcagcagtttgccctcagagttctggcataacacataaagttgtcaggcaactttagtcctcctccaatagtgcaaatcagacacgacagttctcttcaagtatacacacgcacacacatggaccgaaccaaacacgccgtggaagctgagccacacacaccccggtctcaagaagcaaaggaaaaagcacaaagcgtctgagtcaccaattcatcatggcttgtgactgagaaagcgctgtggagtcctggccccgtcggggcagcagacctgcatcagaggtttctttggtaactgaggcaggaagtaaggatgctacattagacagatgttccacgcgtagttcctgctatcatgtttgagggcccccttgtacggataccaagcaagtacaaaaacagaacacaaatcccaacaacatggtttttgcaaataaaccatcccttcccttccccccaccccacccccatgatttttttttttttaagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagctgcaggcaagcaggaaggcaggcagtcagacacaggtggctgcagacagacaggcacggttgcagcaccctccctcaggcagcccagagccggactggctgccacggtcagcgtgggctctgcagacagaacccacctcccccggctaagtcaggcacttgggcaggtcacttttctgtaaaatggtgatgtaccaactgcactgggccagagtccgagttcagaaagagaatgtggcattaaat

SEQ ID NO: 373294 - DNA, 6331 bp, Homo sapiens
  misc_feature (2681)..(2681): n is a, c, g, or t
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatgattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccnaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaagatagtaagtattaaggtttttgtttactgtctatataattaatagaaaccagctattttttctccattaaaacatgcatcacgtttaaagcactatggaatcctccaacctcagctctagtctaacaaactgcagtgttcagagaagataaaatgcccgtgattggtagagtctgcagtccagttgcaagcacctgaaatctagagagagaaagacctataacctgtatgagacttccccttccaaagctgtattgtctacattaaaaaaaacaaaaacagtaacaacaacaaacacacaaatggtcagaaatgtcatccttaaaccctttgtttttcagcagtttgccctcagagttctggcataacacataaagttgtcaggcaactttagtcctcctccaatagtgcaaatcagacacgacagttctcttcaagtatacacacgcacacacatggaccgaaccaaacacgccgtggaagctgagccacacacaccccggtctcaagaagcaaaggaaaaagcacaaagcgtctgagtcaccaattcatcatggcttgtgactgagaaagcgctgtggagtcctggccccgtcggggcagcagacctgcatcagaggtttctttggtaactgaggcaggaagtaaggatgctacattagacagatgttccacgcgtagttcctgctatcatgtttgagggcccccttgtacggataccaagcaagtacaaaaacagaacacaaatcccaacaacatggtttttgcaaataaaccatcccttcccttccccccaccccacccccatgatttttttttttttaagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagctgcaggcaagcaggaaggcaggcagtcagacacaggtggctgcagacagacaggcacggttgcagcaccctccctcaggcagcccagagccggactggctgccacggtcagcgtgggctctgcagacagaacccacctcccccggctaagtcaggcacttgggcaggtcacttttctgtaaaatggtgatgtaccaactgcactgggccagagtccgagttcagaaagagaatgtggcattaaat

SEQ ID NO: 373295 - DNA, 6302 bp, Homo sapiens
  misc_feature (2652)..(2652): n is a, c, g, or t
ggcacgaggggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccaggttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccnaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaagatagtaagtattaaggtttttgtttactgtctatataattaatagaaaccagctattttttctccattaaaacatgcatcacgtttaaagcactatggaatcctccaacctcagctctagtctaacaaactgcagtgttcagagaagataaaatgcccgtgattggtagagtctgcagtccagttgcaagcacctgaaatctagagagagaaagacctataacctgtatgagacttccccttccaaagctgtattgtctacattaaaaaaaacaaaaacagtaacaacaacaaacacacaaatggtcagaaatgtcatccttaaaccctttgtttttcagcagtttgccctcagagttctggcataacacataaagttgtcaggcaactttagtcctcctccaatagtgcaaatcagacacgacagttctcttcaagtatacacacgcacacacatggaccgaaccaaacacgccgtggaagctgagccacacacaccccggtctcaagaagcaaaggaaaaagcacaaagcgtctgagtcaccaattcatcatggcttgtgactgagaaagcgctgtggagtcctggccccgtcggggcagcagacctgcatcagaggtttctttggtaactgaggcaggaagtaaggatgctacattagacagatgttccacgcgtagttcctgctatcatgtttgagggcccccttgtacggataccaagcaagtacaaaaacagaacacaaatcccaacaacatggtttttgcaaataaaccatcccttcccttccccccaccccacccccatgatttttttttttttaagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagctgcaggcaagcaggaaggcaggcagtcagacacaggtggctgcagacagacaggcacggttgcagcaccctccctcaggcagcccagagccggactggctgccacggtcagcgtgggctctgcagacagaacccacctcccccggctaagtcaggcacttgggcaggtcacttttctgtaaaatggtgatgtaccaactgcactgggccagagtccgagttcagaaagagaatgtggcattaaat

SEQ ID NO: 373296 - DNA, 6588 bp, Homo sapiens
  misc_feature (2938)..(2938): n is a, c, g, or t
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagcatctttgagatcttcggctctggatgaagcaggagaggcagaacataaacaaatggacggaagaatcaagcacttctgtgaatggaatcttttattcctcgcccatctgattcttggctgctttgttccataagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccnaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaagatagtaagtattaaggtttttgtttactgtctatataattaatagaaaccagctattttttctccattaaaacatgcatcacgtttaaagcactatggaatcctccaacctcagctctagtctaacaaactgcagtgttcagagaagataaaatgcccgtgattggtagagtctgcagtccagttgcaagcacctgaaatctagagagagaaagacctataacctgtatgagacttccccttccaaagctgtattgtctacattaaaaaaaacaaaaacagtaacaacaacaaacacacaaatggtcagaaatgtcatccttaaaccctttgtttttcagcagtttgccctcagagttctggcataacacataaagttgtcaggcaactttagtcctcctccaatagtgcaaatcagacacgacagttctcttcaagtatacacacgcacacacatggaccgaaccaaacacgccgtggaagctgagccacacacaccccggtctcaagaagcaaaggaaaaagcacaaagcgtctgagtcaccaattcatcatggcttgtgactgagaaagcgctgtggagtcctggccccgtcggggcagcagacctgcatcagaggtttctttggtaactgaggcaggaagtaaggatgctacattagacagatgttccacgcgtagttcctgctatcatgtttgagggcccccttgtacggataccaagcaagtacaaaaacagaacacaaatcccaacaacatggtttttgcaaataaaccatcccttcccttccccccaccccacccccatgatttttttttttttaagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagctgcaggcaagcaggaaggcaggcagtcagacacaggtggctgcagacagacaggcacggttgcagcaccctccctcaggcagcccagagccggactggctgccacggtcagcgtgggctctgcagacagaacccacctcccccggctaagtcaggcacttgggcaggtcacttttctgtaaaatggtgatgtaccaactgcactgggccagagtccgagttcagaaagagaatgtggcattaaat

SEQ ID NO: 373297 - DNA, 4034 bp, Homo sapiens
  misc_feature (2803)..(2803): n is a, c, g, or t
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccnaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagtcacggcgttggatcagtcgcggcgttggatgcagtcacggcgttggatccagtcagcggcgttggatgcagtcagcggcgttgatgcagtcagcggcgttgaatgcagtc

SEQ ID NO: 373298 - DNA, 4442 bp, Homo sapiens
  misc_feature (2803)..(2803): n is a, c, g, or t
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccnaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcgtagttcctgctatcatgtttgagggcccccttgtacggataccaagcaagtacaaaaacagaacacaaatcccaacaacatggtttttgcaaataaaccatcccttcccttccccccaccccacccccatgatttttttttttttaagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagctgcaggcaagcaggaaggcaggcagtcagacacaggtggctgcagacagacaggcacggttgcagcaccctccctcaggcagcccagagccggactggctgccacggtcagcgtgggctctgcagacagaacccacctcccccggctaagtcaggcacttgggcaggtcacttttctgtaaaatggtgatgtaccaactgcactgggccagagtccgagttcagaaagagaatgtggcattaaat

SEQ ID NO: 373299 - DNA, 2945 bp, Homo sapiens
gcaagagtaagttcagcatggagccaggtgacgaggacatagactgtgacaacgaccacgtcttccaaaatgagtcgcatcttcaacccccatctgaacaagactgccaatggagactgccgcagagacccccgggagcggagccggcagccccatcgagcgcgctgtggcccccaccatgagcctgcacggaagccacctgtacacctccctccccagccttggcctggagcagcccctgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaagatagtaagtattaaggtttttgtttactgtctatataattaatagaaaccagctattttttctccattaaaacatgcatcacgtttaaagcactatggaatcctccaacctcagctctagtctaacaaactgcagtgttcagagaagataaaatgcccgtgattggtagagtctgcagtccagttgcaagcacctgaaatctagagagagaaagacctataacctgtatgagacttccccttccaaagctgtattgtctacattaaaaaaaacaaaaacagtaacaacaacaaacacacaaatggtcagaaatgtcatccttaaaccctttgtttttcagcagtttgccctcagagttctggcataacacataaagttgtcaggcaactttagtcctcctccaatagtgcaaatcagacacgacagttctcttcaagtatacacacgcacacacatggaccgaaccaaacacgccgtggaagctgagccacacacaccccggtctcaagaagcaaaggaaaaagcacaaagcgtctgagtcaccaattcatcatggcttgtgactgagaaagcgctgtggagtcctggccccgtcggggcagcagacctgcatcagaggtttctttggtaactgaggcaggaagtaaggatgctacattagacagatgttccacgcgtagttcctgctatcatgtttgagggcccccttgtacggataccaagcaagtacaaaaacagaacacaaatcccaacaacatggtttttgcaaataaaccatcccttcccttccccccaccccacccccatgatttttttttttttaagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagctgcaggcaagcaggaaggcaggcagtcagacacaggtggctgcagacagacaggcacggttgcagcaccctccctcaggcagcccagagccggactggctgccacggtcagcgtgggctctgcagacagaacccacctcccccggctaagtcaggcacttgggcaggtcacttttctgtaaaatggtgatgtaccaactgcactgggccagagtccgagttcagaaagagaatgtggcattaaat

SEQ ID NO: 373300 - DNA, 2714 bp, Homo sapiens
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgaggtaagaacaaaacaagctttctgtagtgaagactgacatgcttaaaactatttgatattcgccatatggaaaaggaagaaagcaattaattttaatttttgtaacttagagcaaatatcactaaataagtctgctagttaccagagaacgaataaccctcagcaagtgctggatactgatgtgtgtaggttgctgtccagtaggtgcctaatacacaaaatcagtgtgataaaggaagtataggttgtagatttccaggcacctcttgtccttactgaagatctgcatgtgtatgaccattggagagagttggctttaatgtccatatatcaaaatgtaagttggtaaagacattggactccagctatgttctttagaaagaaggtattggactctggccatgttcttcagaaagaacatgcctggctttttcacgatttgatcagtcttcttagaccctgaaccccaccatgaaatggcttccccagacacaacccgagagagttatgctttgtttctcagct

SEQ ID NO: 373301 - DNA, 2406 bp, Homo sapiens
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgaggatcatctttctttcatccggcccaagaatggcaccttccccgcccatcaggccacctgcactcaggagtcggctgcctgtcctgaaatagatctctaccagctctcaagcagaacaattccttgcattcatacttgaatgtataatttgtgttattacctcttatttgtctttgtaagtttgtccctgccccagtttaaaaaaaaaaaaaaatct

SEQ ID NO: 373302 - DNA, 2483 bp, Homo sapiens
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaaaccagatcccggcattcaacaaagcactggcaacagtgcttttccagctcttccagcccagcaccgggcatatgaaggaagaacgttcatttcatttccagaagatataccttgcagaagaatcaaggagcccagggaacatccagaaccaagaccccagggacatggccctaaggaagccatcccagccatctccagacatccgagtcacccagctgaggccccagtcaatgtggagcagggacaagaattgtgaagctgtccctgtagtgccatgcccaaatttcttacccacttagtgtagtttcatgtcactgagttttggagtggtttgttatgcagcaatagaaagctagaacacacagtaaacccccaacaagtggtcattattacttaataaaattattattatcagc

SEQ ID NO: 373303 - DNA, 739 bp, Homo sapiens
cggcgggcgagggtgtagtggggtcttgctgggccggttttggaggcctggagtcaaggggcgagctcgccagggagggcgagggtcacagcaagtctcaggatcctcctctgccagtttctgggtggtccttcctcctccagggactcactgattccggctggcgcccttcgtctgtagccgcgtcccctcagactggttcagtccggggtcttctgacttggaagctcgtgctgatttcctaagtcagcccctcctgtcctcttggatccaattcctgtatcttcaccttgtctaccgggatttctagagcagccttgtgagagacatttctgagacctgtatgtcctgcgtctatgattcttccctgatcaagctttcttgggaggcaaccgccactgcacatttcctgtggggatttgatcttaaaaaacaaaagatttagatccatgtggacagaaacttttggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatcgttccctgtgggcatgtgaagctgtgtgcgaagtagattcctcca

SEQ ID NO: 373304 - DNA, 6310 bp, Homo sapiens
  misc_feature (2803)..(2803): n is a, c, g, or t
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccnaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaagatagtaagtattaaggtttttgtttactgtctatataattaatagaaaccagctattttttctccattaaaacatgcatcacgtttaaagcactatggaatcctccaacctcagctctagtctaacaaactgcagtgttcagagaagataaaatgcccgtgattggtagagtctgcagtccagttgcaagcacctgaaatctagagagagaaagacctataacctgtatgagacttccccttccaaagctgtattgtctacattaaaaaaaacaaaaacagtaacaacaacaaacacacaaatggtcagaaatgtcatccttaaaccctttgtttttcagcagtttgccctcagagttctggcataacacataaagttgtcaggcaactttagtcctcctccaatagtgcaaatcagacacgacagttctcttcaagtatacacacgcacacacatggaccgaaccaaacacgccgtggaagctgagccacacacaccccggtctcaagaagcaaaggaaaaagcacaaagcgtctgagtcaccaattcatcatggcttgtgactgagaaagcgctgtggagtcctggccccgtcggggcagcagacctgcatcagaggtttctttggtaactgaggcaggaagtaaggatgctacattagacagatgttccacgcgtagttcctgctatcatgtttgagggcccccttgtacggataccaagcaagtacaaaaacagaacacaaatcccaacaacatggtttttgcaaataaaccatcccttcccttccccccaccccacccccatgatttttttttttttaagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagcgctcggtggcctccggtagctggcaggcccgggcgcggcacagccgctgtgcgcgatggggcagtgcgagaggttgcagttgcgggcgccagccgaggcaca

SEQ ID NO: 373305 - DNA, 5039 bp, Homo sapiens
  misc_feature (2803)..(2803): n is a, c, g, or t
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccnaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctga

SEQ ID NO: 373306 - DNA, 4887 bp, Homo sapiens
  misc_feature (2803)..(2803): n is a, c, g, or t
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccnaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccgctttgatctggagccacgtgtcacccagagctttggcaaaggacggagcatccagcagccctgagtccgcctctcgcagggccagcccgccagcccctctgcccacatggtcagccacagtcactccccctctgtggtctcctgaagggagcgcctcctccaacaacacgtggatctgcatggtttgcctgagctttgaacagtcagtactt

SEQ ID NO: 373307 - DNA, 6347 bp, Homo sapiens
  misc_feature (2803)..(2803): n is a, c, g, or t
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccnaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaagatagtaagtattaaggtttttgtttactgtctatataattaatagaaaccagctattttttctccattaaaacatgcatcacgtttaaagcactatggaatcctccaacctcagctctagtctaacaaactgcagtgttcagagaagataaaatgcccgtgattggtagagtctgcagtccagttgcaagcacctgaaatctagagagagaaagacctataacctgtatgagacttccccttccaaagctgtattgtctacattaaaaaaaacaaaaacagtaacaacaacaaacacacaaatggtcagaaatgtcatccttaaaccctttgtttttcagcagtttgccctcagagttctggcataacacataaagttgtcaggcaactttagtcctcctccaatagtgcaaatcagacacgacagttctcttcaagtatacacacgcacacacatggaccgaaccaaacacgccgtggaagctgagccacacacaccccggtctcaagaagcaaaggaaaaagcacaaagcgtctgagtcaccaattcatcatggcttgtgactgagaaagcgctgtggagtcctggccccgtcggggcagcagacctgcatcagaggtttctttggtaactgaggcaggaagtaaggatgctacattagacagatgttccacgcgtagttcctgctatcatgtttgagggcccccttgtacggataccaagcaagtacaaaaacagaacacaaatcccaacaacatggtttttgcaaataaaccatcccttcccttccccccaccccacccccatgatttttttttttttaagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagctgcaggcaagcaggaaggcaggcagtcagacacaggtggctgcagacagacaggcacggttgcagcaccctccctcaggcagcccagagccggactggctgccacggtcagcgtgggctctgcagacagaacccacctcccccggctaagtcaggcacttgggcaggtcacttttctgtaaaatggtgatgtaccaactgcactgggccagagtccgagttcagaaagagaatgtggcattaaat

SEQ ID NO: 373308 - DNA, 4834 bp, Homo sapiens
  misc_feature (1184)..(1184): n is a, c, g, or t
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacatgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccnaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaagatagtaagtattaaggtttttgtttactgtctatataattaatagaaaccagctattttttctccattaaaacatgcatcacgtttaaagcactatggaatcctccaacctcagctctagtctaacaaactgcagtgttcagagaagataaaatgcccgtgattggtagagtctgcagtccagttgcaagcacctgaaatctagagagagaaagacctataacctgtatgagacttccccttccaaagctgtattgtctacattaaaaaaaacaaaaacagtaacaacaacaaacacacaaatggtcagaaatgtcatccttaaaccctttgtttttcagcagtttgccctcagagttctggcataacacataaagttgtcaggcaactttagtcctcctccaatagtgcaaatcagacacgacagttctcttcaagtatacacacgcacacacatggaccgaaccaaacacgccgtggaagctgagccacacacaccccggtctcaagaagcaaaggaaaaagcacaaagcgtctgagtcaccaattcatcatggcttgtgactgagaaagcgctgtggagtcctggccccgtcggggcagcagacctgcatcagaggtttctttggtaactgaggcaggaagtaaggatgctacattagacagatgttccacgcgtagttcctgctatcatgtttgagggcccccttgtacggataccaagcaagtacaaaaacagaacacaaatcccaacaacatggtttttgcaaataaaccatcccttcccttccccccaccccacccccatgatttttttttttttaagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagctgcaggcaagcaggaaggcaggcagtcagacacaggtggctgcagacagacaggcacggttgcagcaccctccctcaggcagcccagagccggactggctgccacggtcagcgtgggctctgcagacagaacccacctcccccggctaagtcaggcacttgggcaggtcacttttctgtaaaatggtgatgtaccaactgcactgggccagagtccgagttcagaaagagaatgtggcattaaat

SEQ ID NO: 373309 - DNA, 4444 bp, Homo sapiens
  misc_feature (794)..(794): n is a, c, g, or t
gcaatttggtggtgtaattaaaagggagcatgtttgtacctgccagcatctttgagatcttcggctctggatgaagcaggagaggcagaacataaacaaatggacggaagaatcaagcacttctgtgaatggaatcttttattcctcgcccatctgattcttggctgctttgttccataagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccnaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaagatagtaagtattaaggtttttgtttactgtctatataattaatagaaaccagctattttttctccattaaaacatgcatcacgtttaaagcactatggaatcctccaacctcagctctagtctaacaaactgcagtgttcagagaagataaaatgcccgtgattggtagagtctgcagtccagttgcaagcacctgaaatctagagagagaaagacctataacctgtatgagacttccccttccaaagctgtattgtctacattaaaaaaaacaaaaacagtaacaacaacaaacacacaaatggtcagaaatgtcatccttaaaccctttgtttttcagcagtttgccctcagagttctggcataacacataaagttgtcaggcaactttagtcctcctccaatagtgcaaatcagacacgacagttctcttcaagtatacacacgcacacacatggaccgaaccaaacacgccgtggaagctgagccacacacaccccggtctcaagaagcaaaggaaaaagcacaaagcgtctgagtcaccaattcatcatggcttgtgactgagaaagcgctgtggagtcctggccccgtcggggcagcagacctgcatcagaggtttctttggtaactgaggcaggaagtaaggatgctacattagacagatgttccacgcgtagttcctgctatcatgtttgagggcccccttgtacggataccaagcaagtacaaaaacagaacacaaatcccaacaacatggtttttgcaaataaaccatcccttcccttccccccaccccacccccatgatttttttttttttaagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagctgcaggcaagcaggaaggcaggcagtcagacacaggtggctgcagacagacaggcacggttgcagcaccctccctcaggcagcccagagccggactggctgccacggtcagcgtgggctctgcagacagaacccacctcccccggctaagtcaggcacttgggcaggtcacttttctgtaaaatggtgatgtaccaactgcactgggccagagtccgagttcagaaagagaatgtggcattaaat

SEQ ID NO: 373310 - DNA, 5257 bp, Homo sapiens
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaagatagtaagtattaaggtttttgtttactgtctatataattaatagaaaccagctattttttctccattaaaacatgcatcacgtttaaagcactatggaatcctccaacctcagctctagtctaacaaactgcagtgttcagagaagataaaatgcccgtgattggtagagtctgcagtccagttgcaagcacctgaaatctagagagagaaagacctataacctgtatgagacttccccttccaaagctgtattgtctacattaaaaaaaacaaaaacagtaacaacaacaaacacacaaatggtcagaaatgtcatccttaaaccctttgtttttcagcagtttgccctcagagttctggcataacacataaagttgtcaggcaactttagtcctcctccaatagtgcaaatcagacacgacagttctcttcaagtatacacacgcacacacatggaccgaaccaaacacgccgtggaagctgagccacacacaccccggtctcaagaagcaaaggaaaaagcacaaagcgtctgagtcaccaattcatcatggcttgtgactgagaaagcgctgtggagtcctggccccgtcggggcagcagacctgcatcagaggtttctttggtaactgaggcaggaagtaaggatgctacattagacagatgttccacgcgtagttcctgctatcatgtttgagggcccccttgtacggataccaagcaagtacaaaaacagaacacaaatcccaacaacatggtttttgcaaataaaccatcccttcccttccccccaccccacccccatgatttttttttttttaagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagctgcaggcaagcaggaaggcaggcagtcagacacaggtggctgcagacagacaggcacggttgcagcaccctccctcaggcagcccagagccggactggctgccacggtcagcgtgggctctgcagacagaacccacctcccccggctaagtcaggcacttgggcaggtcacttttctgtaaaatggtgatgtaccaactgcactgggccagagtccgagttcagaaagagaatgtggcattaaat

SEQ ID NO: 373311 - DNA, 3659 bp, Homo sapiens
  misc_feature (2803)..(2803): n is a, c, g, or t
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccnaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcatttattgggctagcaaagaaaaccagctctttgcttttgccccaaaagagttaagtttcaaaaatcaattgttgctgagtagctcctggctcttcaacttcacaaaggcagaggcccagcctcagactatcaaaacaaagtatgcaaaag

SEQ ID NO: 373312 - DNA, 2793 bp, Homo sapiens
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagcatctttgagatcttcggctctggatgaagcaggagaggcagaacataaacaaatggacggaagaatcaagcacttctgtgaatggaatcttttattcctcgcccatctgattcttggctgctttgttccataaggtagatgaacaatgatgataaaataaaatgtaaataagaatttttgtgctacaaactcctgaatcgataaatacgttcagtaatgaatgtaagtttctccatgtgctgtgaaatgctaaatggatagaagtgtatttatataattctatttcttttaaacacaagcatcagcatgttttctccctctaatttataaatgtcagcacttatttcttgatatataaattgatacaggatgccacaaacaaaaagttgccgcaaaagataagggcgtttgttagacacagctggaaagctttttagtcactatagaagttagcaggaatgtgattccaaagttaagatggccctcctgagttattcagaactctttcagttgtaagttgcaaattttaaccaacctgaacaagggggaatttttttgcttatgtagttggaatgttactggaactactcataggattacag

SEQ ID NO: 373313 - DNA, 2628 bp, Homo sapiens
gcacgcgcgccgcttcccagtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagcactaagaagattttcttacattgatacctactgtgacaaaacacacatccaatgacagtgttaaaatgtcataaatgagcctttaaaagaatgaggcacatgatacatcatggtacttgagcagactgcaagcctgaccagactgaattcatgaattcctgacttttgacttcttcctgtaagatgctaccccactgccagggactcaacctctaaatccagtcaaggggctacttgggcctggaaccaaggcacagtcaaggtgaaccagctatgctccagggggaggtggttgaaatcactggtctcctggactgggccatgagtgatggttattggggctggggaggtatgagagacatcgtgttgtccatctacctctgtgtatcttcaaaggtctctgtaataaaaagttttctgaaatttactgcctgaca

SEQ ID NO: 373314 - DNA, 1336 bp, Homo sapiens
ccagttcctgcttcttgaaaaaatgggacactgtgacagtgtttacctctcagaagttgcgagagtactcaggtggtggttttgtaacgcatgtaaaaggaagatggcgccagttcctgcttctgaaatctagagagagaaagacctataacctgtatgagacttccccttccaaagctgtattgtctacattaaaaaaaacaaaaacagtaacaacaacaaacacacaaatggtcagaaatgtcatccttaaaccctttgtttttcagcagtttgccctcagagttctggcataacacataaagttgtcaggcaactttagtcctcctccaatagtgcaaatcagacacgacagttctcttcaagtatacacacgcacacacatggaccgaaccaaacacgccgtggaagctgagccacacacaccccggtctcaagaagcaaaggaaaaagcacaaagcgtctgagtcaccaattcatcatggcttgtgactgagaaagcgctgtggagtcctggccccgtcggggcagcagacctgcatcagaggtttctttggtaactgaggcaggaagtaaggatgctacattagacagatgttccacgcgtagttcctgctatcatgtttgagggcccccttgtacggataccaagcaagtacaaaaacagaacacaaatcccaacaacatggtttttgcaaataaaccatcccttcccttccccccaccccacccccatgatttttttttttttaagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagctgcaggcaagcaggaaggcaggcagtcagacacaggtggctgcagacagacaggcacggttgcagcaccctccctcaggcagcccagagccggactggctgccacggtcagcgtgggctctgcagacagaacccacctcccccggctaagtcaggcacttgggcaggtcacttttctgtaaaatggtgatgtaccaactgcactgggccagagtccgagttcagaaagagaatgtggcattaaat

SEQ ID NO: 373315 - DNA, 336 bp, Homo sapiens
ccctcccaagtagtaaaggccccatttgttggcccttataatccgctgggcgcttttaccatccatgaggtcatccccaaaatgcgctgggggcagtcgcagtgtcagcgcggcggcccgagctcccatcacgcctgacctctccgcatgacccagcaggagccgcaccggggcccctctcatcaggatctgctgtgaggccgggcaggctgctgccgcctcacagatcacaccccaaacctagaggcccaaaaccaacaagcatttactattgacacagcgtctcggcggcggctttgctgcgaggctctggcttggggtctcttaggaggttgc

SEQ ID NO: 373316 - DNA, 5008 bp, Homo sapiens
gagtggagttctggaggaatgtttaccagacacagagcccagagggacagcgcccagagcccagatagagagacacggcctcactggctcagcaccagggtccccttccccctcctcagctccctccctggcccctttaagaaagagctgatcctctcctctcttgagttaacccctgattgtccaggtggcccctggctctggcctggtgggcggaggcaaagggggagccaggggcggagaaagggttgcccaagtctgggagtgagggaaggaggcaggggtgctgagaaggcggctgctgggcagagccggtggcaagggcctcccctgccgctgtgccaggcaggcagtgccaaatccggggagcctggagctggggggagggccggggacagcccggccctgccccctcccccgctgggagcccagcaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctacttttttttttttttttttttttttttttttttttgcgatagagtctcactgtgtcacccaggctggagtgcagtggtgcaatctcgcctcactgcaaccttcacctaccgagttcaagtgattttcctgccttggcctcccaagtagctgggattacaggtgtgtgccaccacacccggctaatttttatatttttagtagagacagggtttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactttgtatatcaacga

SEQ ID NO: 373317 - DNA, 3524 bp, Homo sapiens
tgctgggataacaggcatgagccaccacacctggcctccatcccactcttaactcacccatcctacaactttcacacacttctgctttaacctgcacttgtatcacatccattgcatgccctgtccagcccagcccattcagatatgtgaatgcatccatcacacacctcatcaagtatgtgcacatctttgccgaggccttctgcctccctcccacatcacccctttgggtcccagagagctggatccaaggcttcatccatgacctgttcctcataccccctgatgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctacttttttttttttttttttttttttttttttttttgcgatagagtctcactgtgtcacccaggctggagtgcagtggtgcaatctcgcctcactgcaaccttcacctaccgagttcaagtgattttcctgccttggcctcccaagtagctgggattacaggtgtgtgccaccacacccggctaatttttatatttttagtagagacagggtttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactttgtatatcaacga

SEQ ID NO: 373318 - DNA, 5037 bp, Homo sapiens
gagtggagttctggaggaatgtttaccagacacagagcccagagggacagcgcccagagcccagatagagagacacggcctcactggctcagcaccagggtccccttccccctcctcagctccctccctggcccctttaagaaagagctgatcctctcctctcttgagttaacccctgattgtccaggtggcccctggctctggcctggtgggcggaggcaaagggggagccaggggcggagaaagggttgcccaagtctgggagtgagggaaggaggcaggggtgctgagaaggcggctgctgggcagagccggtggcaagggcctcccctgccgctgtgccaggcaggcagtgccaaatccggggagcctggagctggggggagggccggggacagcccggccctgccccctcccccgctgggagcccagcaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctacttttttttttttttttttttttttttttttttttgcgatagagtctcactgtgtcacccaggctggagtgcagtggtgcaatctcgcctcactgcaaccttcacctaccgagttcaagtgattttcctgccttggcctcccaagtagctgggattacaggtgtgtgccaccacacccggctaatttttatatttttagtagagacagggtttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctataccacggctcaggtacattaacttgtcggggtagttctttcttggttcttgttagttttctgtgtttt

SEQ ID NO: 373319 - DNA, 4954 bp, Homo sapiens
gagtggagttctggaggaatgtttaccagacacagagcccagagggacagcgcccagagcccagatagagagacacggcctcactggctcagcaccagggtccccttccccctcctcagctccctccctggcccctttaagaaagagctgatcctctcctctcttgagttaacccctgattgtccaggtggcccctggctctggcctggtgggcggaggcaaagggggagccaggggcggagaaagggttgcccaagtctgggagtgagggaaggaggcaggggtgctgagaaggcggctgctgggcagagccggtggcaagggcctcccctgccgctgtgccaggcaggcagtgccaaatccggggagcctggagctggggggagggccggggacagcccggccctgccccctcccccgctgggagcccagcaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctacttttttttttttttttttttttttttttttttttgcgatagagtctcactgtgtcacccaggctggagtgcagtggtgcaatctcgcctcactgcaaccttcacctaccgagttcaagtgattttcctgccttggcctcccaagtagctgggattacaggtgtgtgccaccacacccggctaatttttatatttttagtagagacagggtttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttcttaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactttgtatatcaacga

SEQ ID NO: 373320 - DNA, 4885 bp, Homo sapiens
gagtggagttctggaggaatgtttaccagacacagagcccagagggacagcgcccagagcccagatagagagacacggcctcactggctcagcaccagggtccccttccccctcctcagctccctccctggcccctttaagaaagagctgatcctctcctctcttgagttaacccctgattgtccaggtggcccctggctctggcctggtgggcggaggcaaagggggagccaggggcggagaaagggttgcccaagtctgggagtgagggaaggaggcaggggtgctgagaaggcggctgctgggcagagccggtggcaagggcctcccctgccgctgtgccaggcaggcagtgccaaatccggggagcctggagctggggggagggccggggacagcccggccctgccccctcccccgctgggagcccagcaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctacttttttttttttttttttttttttttttttttttgcgatagagtctcactgtgtcacccaggctggagtgcagtggtgcaatctcgcctcactgcaaccttcacctaccgagttcaagtgattttcctgccttggcctcccaagtagctgggattacaggtgtgtgccaccacacccggctaatttttatatttttagtagagacagggtttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactatttaagcgctggccaaaaaaacttttttttttttccccaaaaaaagggggggtttttctaaaacccctatactgtagtattcctttggggggtggccccctcttccttttctttaggttaattcattttggttttccctcccttccccaaaattggttt

SEQ ID NO: 373321 - DNA, 1409 bp, Homo sapiens
  misc_feature (58)..(58): n is a, c, g, or t
  misc_feature (74)..(74): n is a, c, g, or t
aaccccctaaacccggttaaaagccttgctgaatagggggcctcccaaggaaaccccnaaaggggacagaaggnaatgggtgcctggagaaaaaacccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactttgtatatcaacga

SEQ ID NO: 373322 - DNA, 404 bp, Homo sapiens
cagtgtttcaacaatggatctatccctactggtgggtgaatgtcacctgaatgtcagccctgctccatgactctgtccaccccaaccttgcatgcagtgaacagcctgggcatcagtgaagagctgaaggagaagctgcgggatgtgatggtggaccggcacaaggtggccctggggaagactctgggagagggtgagtcccccggcagcatacacacatccttctgaacttctgagatcctgcacttccacactcccacccaactataggaaatacagtccccacgggccctctgaggtcagtgtctccctctggccccccacaggagagtttggagctgtgatggaaggccagctcaaccaggacgactccatcctcaaggtggctgtgaagacgatgaaga

SEQ ID NO: 373323 - DNA, 339 bp, Homo sapiens
gatgaggagttggaggatggggagagcgttttgagaaagagatggggcattgagcccgagagtgaaggcttaacagctggggggtaaggttctaccctgatgccacttctggacctcctaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccaggtccaaagccatgcccaacctgcttcaacctgtctctccctgacagccctgacttactccttgtacc

SEQ ID NO: 373324 - DNA, 4981 bp, Homo sapiens
gagtggagttctggaggaatgtttaccagacacagagcccagagggacagcgcccagagcccagatagagagacacggcctcactggctcagcaccagggtccccttccccctcctcagctccctccctggcccctttaagaaagagctgatcctctcctctcttgagttaacccctgattgtccaggtggcccctggctctggcctggtgggcggaggcaaagggggagccaggggcggagaaagggttgcccaagtctgggagtgagggaaggaggcaggggtgctgagaaggcggctgctgggcagagccggtggcaagggcctcccctgccgctgtgccaggcaggcagtgccaaatccggggagcctggagctggggggagggccggggacagcccggccctgccccctcccccgctgggagcccagcaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctacttttttttttttttttttttttttttttttttttgcgatagagtctcactgtgtcacccaggctggagtgcagtggtgcaatctcgcctcactgcaaccttcacctaccgagttcaagtgattttcctgccttggcctcccaagtagctgggattacaggtgtgtgccaccacacccggctaatttttatatttttagtagagacagggtttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactttgtatatcaacga

SEQ ID NO: 373325 - DNA, 4461 bp, Homo sapiens
gagtggagttctggaggaatgtttaccagacacagagcccagagggacagcgcccagagcccagatagagagacacggcctcactggctcagcaccagggtccccttccccctcctcagctccctccctggcccctttaagaaagagctgatcctctcctctcttgagttaacccctgattgtccaggtggcccctggctctggcctggtgggcggaggcaaagggggagccaggggcggagaaagggttgcccaagtctgggagtgagggaaggaggcaggggtgctgagaaggcggctgctgggcagagccggtggcaagggcctcccctgccgctgtgccaggcaggcagtgccaaatccggggagcctggagctggggggagggccggggacagcccggccctgccccctcccccgctgggagcccagcaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactttgtatatcaacga

SEQ ID NO: 373326 - DNA, 327 bp, Homo sapiens
aggacgaggaaggatgaggagttggaggatggggagagcgttttgagaaagagatggggcattgagcccgagagtgaaggcttaacagctggggggtaaggttctaccctgatgccacttctggacctcctaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccaggtccaaagccatgcccaacctgcttcaacctgtctctccctga

SEQ ID NO: 373327 - DNA, 3911 bp, Homo sapiens
cccaactcaaacaggcagataaagagagatcaaagagatgagcatgagatacagtcccctcgtgcccaaggagacagggtggttacagacatggaaaatctgagaataatcacctctgataaagatcacagaagctgcccgggaggtgtttggtaagcttggagttacgtttgtggggtggatgggcagaagtcagatttcatagcactgaggatgcagcacaaggagaagttcaagatcaattcctaagacaacaacttggcactaaaaaacataaactatgttctgaaggctttaccctggggacaagggaagggaggtgataacagcagaagtggcagccactggcgatcctttctttccatggtttggcttctactccaaagccacttatttgtgcattctacaaaaagtttcttgtcctttttgaaataaagctcttatcctaagctccattcacacctgcgtgataatgaaccagctagtacttactgtactcaggaagcatgcaaagttctgaatcttagaacagaaagtgaaagcaaaagtaaattccccttcagtcaaatctgcagcagcatgatttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcccggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatgctcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggctcagtctgggacaggatgctccgctcggctctcttgaagctggcctgtgacctgaaccatgctccttgcatccagaaagctgctgaactcttctcccagtggatggaatccagtggaaaattaaatataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttccgactctgaggacttggctaatggttaatacttaaatggtcaatagaaaaagtaggctgggcgcggtggctcacgcctgtaatcccagcactttgggaggctgagaagggcggatcacgaggtcaggagatggagaccatcctggctaacacggtgagaccccgtctccgctaaaaatacaaaaaattagccgggcatggtggcaggtgcctgtagtcccagctactcggcaggctgcagcaggaaaatggcataaacccgggaggtggagcttgcagtgagccgagattgcaccactgcattccagcctgggtgactgagcgagactctgtctcaaaaaaaaaaaaaaaaa

SEQ ID NO: 373328 - DNA, 3967 bp, Homo sapiens
cccaactcaaacaggcagataaagagagatcaaagagatgagcatgagatacagtcccctcgtgcccaaggagacagggtggttacagacatggaaaatctgagaataatcacctctgataaagatcacagaagctgcccgggaggtgtttggtaagcttggagttacgtttgtggggtggatgggcagaagtcagatttcatagcactgaggatgcagcacaaggagaagttcaagatcaattcctaagacaacaacttggcactaaaaaacataaactatgttctgaaggctttaccctggggacaagggaagggaggtgataacagcagaagtggcagccactggcgatcctttctttccatggtttggcttctactccaaagccacttatttgtgcattctacaaaaagtttcttgtcctttttgaaataaagctcttatcctaagctccattcacacctgcgtgataatgaaccagctagtacttactgtactcaggaagcatgcaaagttctgaatcttagaacagaaagtgaaagcaaaagtaaattccccttcagtcaaatctgcagcagcatgatttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcccggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatggtgaggataaagagagtcacagagtagaagagatctgtggaatagcctgacctagactcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggctcagtctgggacaggatgctccgctcggctctcttgaagctggcctgtgacctgaaccatgctccttgcatccagaaagctgctgaactcttctcccagtggatggaatccagtggaaaattaaatataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttccgactctgaggacttggctaatggttaatacttaaatggtcaatagaaaaagtaggctgggcgcggtggctcacgcctgtaatcccagcactttgggaggctgagaagggcggatcacgaggtcaggagatggagaccatcctggctaacacggtgagaccccgtctccgctaaaaatacaaaaaattagccgggcatggtggcaggtgcctgtagtcccagctactcggcaggctgcagcaggaaaatggcataaacccgggaggtggagcttgcagtgagccgagattgcaccactgcattccagcctgggtgactgagcgagactctgtctcaaaaaaaaaaaaaaaaa

SEQ ID NO: 373329 - DNA, 3530 bp, Homo sapiens
cccaactcaaacaggcagataaagagagatcaaagagatgagcatgagatacagtcccctcgtgcccaaggagacagggtggttacagacatggaaaatctgagaataatcacctctgataaagatcacagaagctgcccgggaggtgtttggtaagcttggagttacgtttgtggggtggatgggcagaagtcagatttcatagcactgaggatgcagcacaaggagaagttcaagatcaattcctaagacaacaacttggcactaaaaaacataaactatgttctgaaggctttaccctggggacaagggaagggaggtgataacagcagaagtggcagccactggcgatcctttctttccatggtttggcttctactccaaagccacttatttgtgcattctacaaaaagtttcttgtcctttttgaaataaagctcttatcctaagctccattcacacctgcgtgataatgaaccagctagtacttactgtactcaggaagcatgcaaagttctgaatcttagaacagaaagtgaaagcaaaagtaaattccccttcagtcaaatctgcagcagcatgatttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcccggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatgctcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggctcagtctgggacaggatgctccgctcggctctcttgaagctggcctgtgacctgaaccatgctccttgcatccagaaagctgctgaactcttctcccagtggatggaatccagtggaaaattaaatataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtttgtgactttctgtttttaacaatttcaaaataaatgttcaaattgtggaattgaaagtaaacttagatataatctga

SEQ ID NO: 373330 - DNA, 1863 bp, Homo sapiens
cccaactcaaacaggcagataaagagagatcaaagagatgagcatgagatacagtcccctcgtgcccaaggagacagggtggttacagacatggaaaatctgagaataatcacctctgataaagatcacagaagctgcccgggaggtgtttggtaagcttggagttacgtttgtggggtggatgggcagaagtcagatttcatagcactgaggatgcagcacaaggagaagttcaagatcaattcctaagacaacaacttggcactaaaaaacataaactatgttctgaaggctttaccctggggacaagggaagggaggtgataacagcagaagtggcagccactggcgatcctttctttccatggtttggcttctactccaaagccacttatttgtgcattctacaaaaagtttcttgtcctttttgaaataaagctcttatcctaagctccattcacacctgcgtgataatgaaccagctagtacttactgtactcaggaagcatgcaaagttctgaatcttagaacagaaagtgaaagcaaaagtaaattccccttcagtcaaatctgcagcagcatgatttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcccggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactgggtatgttcaaattccacattattgtcttcatttttgctcataaaacttgctttgatctcttccctctttctctttctatgtgatttaaatgagcactgaggaattcagttagctcaggaaaaaataatttgttcctcagagatgattcttgagtgtagaaaataaaatatttatgacatgcc

SEQ ID NO: 373331 - DNA, 437 bp, Homo sapiens
tctctactaaaggtgattttattttatatccattgatattcccctttcagataggaaattaaaccatgtttaaatgcaaaaactgtttcctaagtatggtgggtaacagccagaaaaagataagagaaatacgaagatacactgtttggggaaagattgggaaagatgcagaaagtttagagttgagccctttagatgggcaagaactgtgttaaggactaaatttagcctctctgttaaccatctcatattttctgcagcgttaccttcttcagtattttaagccagtgattgacaggcaaagctggagtgacaagggctcagtctgggacaggatgctccgctcggctctcttgaagctggcctgtgacctgaaccatgctccttgcatccagaaagctgctgaactcttctcccagtggatggaatccagtgga

SEQ ID NO: 373332 - DNA, 534 bp, Homo sapiens
agaaaaaagaaaaccaagcaaaaatgtggtggtgagaataagaaggcaaggaaatcagtagaagaaaattgtacagagagaaaagggtagcaaagagagaagagagatcctaactaataaaaaaaaagttagtaactattgtattttttgctaaagttaataatttttatttgtttaacttctaataatattgagtttttacctcctagtggtttggcaacctggtcacaatggaatggtggaatgatatttggcttaaggagggttttgcaaaatacatggaacttatcgctgttaatgctacatatccagagctgcaatttgtaagttcacaattctgtgtatcatactatatggtgtaaagaatcatcaattcactattaaaatttcaagtgaatgttaaacagaaaaactacataatgttgtggtttttgaacatatggcattttgtttgatacacgaaacagatcacagaactggatgaaacattgaaggttttagaaaacaatcaacataaatctgtcaccccaaagt

SEQ ID NO: 373333 - DNA, 3754 bp, Homo sapiens
cccaactcaaacaggcagataaagagagatcaaagagatgagcatgagatacagtcccctcgtgcccaaggagacagggtggttacagacatggaaaatctgagaataatcacctctgataaagatcacagaagctgcccgggaggtgtttggtaagcttggagttacgtttgtggggtggatgggcagaagtcagatttcatagcactgaggatgcagcacaaggagaagttcaagatcaattcctaagacaacaacttggcactaaaaaacataaactatgttctgaaggctttaccctggggacaagggaagggaggtgataacagcagaagtggcagccactggcgatcctttctttccatggtttggcttctactccaaagccacttatttgtgcattctacaaaaagtttcttgtcctttttgaaataaagctcttatcctaagctccattcacacctgcgtgataatgaaccagctagtacttactgtactcaggaagcatgcaaagttctgaatcttagaacagaaagtgaaagcaaaagtaaattccccttcagtcaaatctgcagcagcatgatttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcccggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatgctcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggctcagtctgggacaggatgctccgctcggctctcttgaagctggcctgtgacctgaaccatgctccttgcatccagaaagctgctgaactcttctcccagtggatggaatccagtggaaaattaaagtagatgtagacttctgtcctaccctttgttcttttctctttgatgtaaaagtctttgatcaagcaagacattaggtctaaaaccttttagtgaggatagaaaaaaaaacatgctgggcattacaaaccctgtttcatgctctcacattgtaagtgctatgtatggagactagtacaatctctaccatgaaatgtaatggtgtccattattccggtgctggctggatgcagtggcccacgcctataatcccagcactttgggaggccaaggagggtgaatcactgaggtcaggagttcaagaccagcctggccaacatagtgaagccctgtctgcactaaaaatgcaaaaattagccaagtgtggtggtgcacgcttgtaatcccagctacttcggaggctgaggtgggagaattgcttgaacctgggaagcagaagttgccgtgagccaagatcacttcactgcactgcagtctgggcaacagagaaaggccctgtctcaaaaaaaaaaaaaaaacttttcctgtgccaaattattataagatggtatcataacttctctcgctataactaaatctgtgagctttttgaaatcctttcttgaattcttctttttaaaaaagtaattcaagttttcttctttttggactttttttccttgttgggattcaagcctgaaatcagttttag

SEQ ID NO: 373334 - DNA, 3633 bp, Homo sapiens
  misc_feature (3559)..(3559): n is a, c, g, or t
  misc_feature (3562)..(3562): n is a, c, g, or t
  misc_feature (3571)..(3571): n is a, c, g, or t
  misc_feature (3578)..(3578): n is a, c, g, or t
  misc_feature (3588)..(3588): n is a, c, g, or t
cccaactcaaacaggcagataaagagagatcaaagagatgagcatgagatacagtcccctcgtgcccaaggagacagggtggttacagacatggaaaatctgagaataatcacctctgataaagatcacagaagctgcccgggaggtgtttggtaagcttggagttacgtttgtggggtggatgggcagaagtcagatttcatagcactgaggatgcagcacaaggagaagttcaagatcaattcctaagacaacaacttggcactaaaaaacataaactatgttctgaaggctttaccctggggacaagggaagggaggtgataacagcagaagtggcagccactggcgatcctttctttccatggtttggcttctactccaaagccacttatttgtgcattctacaaaaagtttcttgtcctttttgaaataaagctcttatcctaagctccattcacacctgcgtgataatgaaccagctagtacttactgtactcaggaagcatgcaaagttctgaatcttagaacagaaagtgaaagcaaaagtaaattccccttcagtcaaatctgcagcagcatgatttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcccggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatgctcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggctcagtctgggacaggatgctccgctcggctctcttgaagctggcctgtgacctgaaccatgctccttgcatccagaaagctgctgaactcttctcccagtggatggaatccagtggaaaattaaatataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttnatnttctactcnttcatantcatggaccnacactcacttgcatctttggaggtattggcgggatcctctagatc

SEQ ID NO: 373335 - DNA, 556 bp, Homo sapiens
agcgggcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattc

SEQ ID NO: 373336 - DNA, 771 bp, Homo sapiens
agcgggcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcaaaaaaaaaaaaaaacaaacttcgaggggggttgaaaagccttgagcagcaagggcccccgggaaacccctgtgtacaagggggcgcgggaaagcccggaacgggaaaccagggaaagcgccgaaagttctcgggaaacggtgaatttgcaaatcagttggaaaactttttgaccccaaaagggacaagcgcttccggggccccgaaggcttaac

SEQ ID NO: 373337 - DNA, 595 bp, Homo sapiens
agcgggcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcccatgattctgttctgtgggtatttcaactcttaattcc

SEQ ID NO: 373338 - DNA, 648 bp, Homo sapiens
agcgggcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcggtgagacagccacggggcgggcggcgggcgggacgcgggaggaacgcgagagggagcgcgggcgccagaccactatcctcctccgcccccagggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattc

SEQ ID NO: 373339 - DNA, 1506 bp, Homo sapiens
agcgggcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcggtgagacagccacggggcgggcggcgggcgggacgcgggaggaacgcgagagggagcgcgggcgccagaccactatcctcctccgcccccagggatccctcggtgaagaggactctctgtcgaggctgctcttccctcctcgtcccgggcctcacctgcacccagcgccagagacgtgagtgctccaacggaggtggaagactgcggagcattgggggcgcggaggggggcggggtggggggcgggcactggaggccaacagcgcctttctcactgtagatggatgttgggtgtgggattcgcaggagtcttccttcttcgggtttggattaagttcctaacgccacttgcacaaactagggtttgggctcggctgttttttttttttttcttccagtgtgggcaataaataataacttttaagaggcaaccccacccatgcacaataatagatgttgttcggctttgtggaggacgattcccatcaccattcatttattaagcaaatacttattttctaaaatgtgtcaggtactgtgctagattcattattctcattgaaattacggtctgatgggacagactaagaaacaaaatggtgtagaaaaagattaactgggggagtagaatgctcacttactcatgccagtggtggcgaagtttatgataagcaaagggagtgagagatggaaattctaggcatgtgtgcagactctgagacaagagagcttgtggtgctgtcaaagaaatgagagttcaggaggctggagtttgaggtaggagggcaaaacatgagactggagggggaaacaggccagttcttgaagtcttgttagggagtttgaactttatcttaaagagttccaggaaatcgatggagcttatgccgaggcctgacaccatcaaatgtgcattcaaattgggggtgtggtgggggagcggggatacctactgaaaaacactggaggcaaaactggcagcaagagaccgttacttctaaacgtggacagtctttttcccatgttcaccctaggctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattc

SEQ ID NO: 373340 - DNA, 912 bp, Homo sapiens
agcgggcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgtgagtgctccaacggaggtggaagactgcggagcattgggggcgcggaggggggcggggtggggggcgggcactggaggccaacagcgcctttctcactgtagatggatgttgggtgtgggattcgcaggagtcttccttcttcgggtttggattaagttcctaacgccacttgcacaaactagggtttgggctcggctgttttttttttttttcttccagtgtgggcaataaataataacttttaagaggcaaccccacccatgcacaataatagatgttgttcggctttgtggaggacgattcccatcaccattcatttattaagcaaatacttattttctaaaatgtgtcaggctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattc

SEQ ID NO: 373341 - DNA, 1629 bp, Homo sapiens
agcgggcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgtgagtgctccaacggaggtggaagactgcggagcattgggggcgcggaggggggcggggtggggggcgggcactggaggccaacagcgcctttctcactgtagatggatgttgggtgtgggattcgcaggagtcttccttcttcgggtttggattaagttcctaacgccacttgcacaaactagggtttgggctcggctgttttttttttttttcttccagtgtgggcaataaataataacttttaagaggcaaccccacccatgcacaataatagatgttgttcggctttgtggaggacgattcccatcaccattcatttattaagcaaatacttattttctaaaatgtgtcaggtactgtgctagattcattattctcattgaaattacggtctgatgggacagactaagaaacaaaatggtgtagaaaaagattaactgggggagtagaatgctcacttactcatgccagtggtggcgaagtttatgataagcaaagggagtgagagatggaaattctaggcatgtgtgcagactctgagacaagagagcttgtggtgctgtcaaagaaatgagagttcaggaggctggagtttgaggtaggagggcaaaacatgagactggagggggaaacaggccagttcttgaagtcttgttagggagtttgaactttatcttaaagagttccaggaaatcgatggagcttatgccgaggcctgacaccatcaaatgtgcattcaaattgggggtgtggtgggggagcggggatacctactgaaaaacactggaggcaaaactggcagcaagagaccgttacttctaaacgtggacagtctttttcccatgttcaccctaggctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcaaaaaaaaaaaaaaacaaacttcgaggggggttgaaaagccttgagcagcaagggcccccgggaaacccctgtgtacaagggggcgcgggaaagcccggaacgggaaaccagggaaagcgccgaaagttctcgggaaacggtgaatttgcaaatcagttggaaaactttttgaccccaaaagggacaagcgcttccggggccccgaaggcttaac

SEQ ID NO: 373342 - DNA, 994 bp, Homo sapiens
agcgggcgaggggtggggctgcgggaggccctggagcgcggcggtgatggcggggccggtgaaggaccgcgaggccttccagaggctcaacttcctgtaccaggtgagtctgcgacaagggccccacggggacggtgctcggcgtcccagagtgactgctcccctcccgcaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcaaaaaaaaaaaaaaaaaaaaaaaaaaaaaaaaaaaaaaaacaaaaaaaaaaaaaaaaaagagagggggggggaaaagaaaaaatattccacgaagggaggagccaaagaacaaagaccgagacccaggacatagtgtgtgaaaaaaggggcaccaccaggcgacgagacaaaaaaacaaagagcgaggccgccggaacaaacgaggcggagtgagcaaccggcaaccggagcacacatggggagccaaaccacaccgggggggcgaacgacgtggaccaaccacagcagaatacaacgaggggacacacactaagggtgaatgtggaaccaacgacatgggcgaaacaaggcacggaaaaccaattgga

SEQ ID NO: 373343 - DNA, 532 bp, Homo sapiens
agcgggcgaggggtggggctgcgggaggccctggagcgcggcggtgatggcggggccggtgaaggaccgcgaggccttccagaggctcaacttcctgtaccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattc

SEQ ID NO: 373344 - DNA, 580 bp, Homo sapiens
agcgggcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgaccactatcctcctccgcccccagggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattc

SEQ ID NO: 373345 - DNA, 625 bp, Homo sapiens
agcgggcgaggggtggggctgcgggaggccctggagcgcggcggtgatggcggggccggtgaaggaccgcgaggccttccagaggctcaacttcctgtaccaggtgagtctgcgacaagggccccacggggacggtgctcggcgtcccagagtgactgctcccctcccgcaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattc

SEQ ID NO: 373346 - DNA, 1414 bp, Homo sapiens
agcgggcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgtgagtgctccaacggaggtggaagactgcggagcattgggggcgcggaggggggcggggtggggggcgggcactggaggccaacagcgcctttctcactgtagatggatgttgggtgtgggattcgcaggagtcttccttcttcgggtttggattaagttcctaacgccacttgcacaaactagggtttgggctcggctgttttttttttttttcttccagtgtgggcaataaataataacttttaagaggcaaccccacccatgcacaataatagatgttgttcggctttgtggaggacgattcccatcaccattcatttattaagcaaatacttattttctaaaatgtgtcaggtactgtgctagattcattattctcattgaaattacggtctgatgggacagactaagaaacaaaatggtgtagaaaaagattaactgggggagtagaatgctcacttactcatgccagtggtggcgaagtttatgataagcaaagggagtgagagatggaaattctaggcatgtgtgcagactctgagacaagagagcttgtggtgctgtcaaagaaatgagagttcaggaggctggagtttgaggtaggagggcaaaacatgagactggagggggaaacaggccagttcttgaagtcttgttagggagtttgaactttatcttaaagagttccaggaaatcgatggagcttatgccgaggcctgacaccatcaaatgtgcattcaaattgggggtgtggtgggggagcggggatacctactgaaaaacactggaggcaaaactggcagcaagagaccgttacttctaaacgtggacagtctttttcccatgttcaccctaggctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattc

SEQ ID NO: 373347 - DNA, 508 bp, Homo sapiens
agcgggcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagaccgccttcctgaggagaaaatgcagactcagggttccagtaaccagtgatggattcaccccatctcccaaataaagtttacttgttttacattc

SEQ ID NO: 373348 - DNA, 523 bp, Homo sapiens
  misc_feature (7)..(8): n is a, c, g, or t
gcggccnnctactactactaaattcgcggccgcgtcgacttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttca

SEQ ID NO: 373349 - DNA, 885 bp, Homo sapiens
  misc_feature (578)..(578): n is a, c, g, or t
  misc_feature (580)..(580): n is a, c, g, or t
  misc_feature (596)..(596): n is a, c, g, or t
  misc_feature (676)..(676): n is a, c, g, or t
  misc_feature (681)..(681): n is a, c, g, or t
  misc_feature (685)..(685): n is a, c, g, or t
  misc_feature (704)..(704): n is a, c, g, or t
ccacgcgtcgcggacgcgtgggtcgacccacgcgtcgcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaacccgggggntntttttggggggggggnaaaaggggtttgaaggggccggggcttttttttccggccccccttttttttgcaggggggaaatcggggggccccccaanggggngcgncaaaaaatcggcgaagagngcagttgccgcggttatattctccgtgctaaaaaaggagtgagacacgacgagagcgagcagcggaggacaacccactactagacacaaagtgtggctggaaaaccaataacacaagagaaaagcaaatcagagagacaaaagagacgcaccgagacaagagaacaagacacaaccaaaag

SEQ ID NO: 373350 - DNA, 539 bp, Homo sapiens
  misc_feature (2)..(2): n is a, c, g, or t
  misc_feature (19)..(19): n is a, c, g, or t
tnccgaattcggcagaggnacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttca

SEQ ID NO: 373351 - DNA, 522 bp, Homo sapiens
ccacgcgtcgcggacgcgtgggtcgacccacgcgtcgcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttca

SEQ ID NO: 373352 - DNA, 994 bp, Homo sapiens
  misc_feature (622)..(624): n is a, c, g, or t
ccccaccccccaccacaccttccggctaggtacgaggactcggttaatcgccgagggagcgcctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcaaaaaaaaaacaacaaaaaacacaaaaaaaaaaacaaaaaaaaaaaannngggggggggccaaaaaaaataccccggggggggcccacatttgggcagtacacccgggtttttttgtacgcagggggggccccataatggggagggcgctataaaaagaagcgaggaacgacgcggggccggtttaacacagccgtgtccgcgcggcgtggcacagcactccgtctcagctggggcactctgggggaaaggcgacacccccataccgccgggggggcgccccctgtgggcaccccacaccacacaagaattgaacgcccgagggcagacaatacaccttcccgtgtgctccggttgggcacccccaccgcatatgtcgtggccgacaagaaatcgccccgggacttgattgaaaataacg

SEQ ID NO: 373353 - DNA, 651 bp, Homo sapiens
atcccccgggctgcaggaattggcacgagcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcaaaaaaaaaacaacaaaaaacacaaaaaaaaaaactcgaggggggcccggtcccaatttggcctatagtgaagcgtattacatttacctgcccgtggtttacaacgtcgtgactggg

SEQ ID NO: 373354 - DNA, 741 bp, Homo sapiens
catcatctttagacttaaggaattaacaagggtcagggagaccccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcactcaacatacatctccactccttaccgacccgcaccaaccatgtcgggcccgcttggtccacccgaattttgatccggccagtcttatgcatcgcggccgcaatccggtccctttcggccaatcgcgcttttaggcggtcattctacttcactgcccctctcg

SEQ ID NO: 373355 - DNA, 767 bp, Homo sapiens
  misc_feature (2)..(2): n is a, c, g, or t
  misc_feature (19)..(19): n is a, c, g, or t
tnccgaattcggcagaggnacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaggggctctctcaccagggaacgtgaccttgagttccggaattcctggcggttccaaggggggcgaatcggggcagcctggattggctggagtggtcatctcaaaccccaatctatcctggcccctggtggcatgtccggaatgattggcaggtccttcctaaacagtccggcctaattcccccgggtttggcacggaaaatccctggtggctga

SEQ ID NO: 373356 - DNA, 325 bp, Homo sapiens
gggctgcaggaattcggcacgaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttca

SEQ ID NO: 373357 - DNA, 286 bp, Homo sapiens
gcggccgcctactactactactactgctcgaattcaagcttctaacgatgtacggggataaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttca

SEQ ID NO: 373358 - DNA, 211 bp, Homo sapiens
  misc_feature (22)..(22): n is a, c, g, or t
  misc_feature (31)..(31): n is a, c, g, or t
  misc_feature (33)..(33): n is a, c, g, or t
  misc_feature (36)..(37): n is a, c, g, or t
aattcgcggccgcgtcgacacngcgcgatangncgnnagaagccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttca

SEQ ID NO: 373359 - DNA, 203 bp, Homo sapiens
  misc_feature (46)..(46): n is a, c, g, or t
tcggttgcccaccaccgaaagaaaagggcctcggtgaccaacaggnagactagagaagaaacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttca

SEQ ID NO: 373360 - DNA, 931 bp, Homo sapiens
  misc_feature (679)..(679): n is a, c, g, or t
accgcgcggtcgctcagcagacgaggtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaaaaaaaaaaacaaaaaaaaacaaaaaaaaaaaaaagaaaaaaaaaaaaaaaaaaaaaaaanagggggggggggccctaaaaaatatccccgcggggggccccagagctaagcgcgcgccaccccacgatgtgtggtacgaaagcggggctccccctaaggaggaggcgcgccattaaaaaaacgagagcagccggcggccgcgatgataaaacacacgcgacggtagcgcggacaacaatgcgctgccgaggagaacactggggagagaggcaccacaccggcggggaggcaacacagctgggacacaccaca

SEQ ID NO: 373361 - DNA, 883 bp, Homo sapiens
  misc_feature (631)..(631): n is a, c, g, or t
accgcgcggtcgctcagcagacgaggtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaaaaaaaaaaaaanagggggggggggccctaaaaaatatccccgcggggggccccagagctaagcgcgcgccaccccacgatgtgtggtacgaaagcggggctccccctaaggaggaggcgcgccattaaaaaaacgagagcagccggcggccgcgatgataaaacacacgcgacggtagcgcggacaacaatgcgctgccgaggagaacactggggagagaggcaccacaccggcggggaggcaacacagctgggacacaccaca

SEQ ID NO: 373362 - DNA, 935 bp, Homo sapiens
  misc_feature (628)..(628): n is a, c, g, or t
  misc_feature (630)..(630): n is a, c, g, or t
  misc_feature (646)..(646): n is a, c, g, or t
  misc_feature (726)..(726): n is a, c, g, or t
  misc_feature (731)..(731): n is a, c, g, or t
  misc_feature (735)..(735): n is a, c, g, or t
  misc_feature (754)..(754): n is a, c, g, or t
accgcgcggtcgctcagcagacgaggtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaacccgggggntntttttggggggggggnaaaaggggtttgaaggggccggggcttttttttccggccccccttttttttgcaggggggaaatcggggggccccccaanggggngcgncaaaaaatcggcgaagagngcagttgccgcggttatattctccgtgctaaaaaaggagtgagacacgacgagagcgagcagcggaggacaacccactactagacacaaagtgtggctggaaaaccaataacacaagagaaaagcaaatcagagagacaaaagagacgcaccgagacaagagaacaagacacaaccaaaag

SEQ ID NO: 373363 - DNA, 894 bp, Homo sapiens
  misc_feature (642)..(642): n is a, c, g, or t
atcccccgggctgcaggaattggcacgagcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaaaaaaaaaaacaaaaaaaaacaaaaaaaaaaaaaagaaaaaaaaaaaaaaaaaaaaaaaanagggggggggggccctaaaaaatatccccgcggggggccccagagctaagcgcgcgccaccccacgatgtgtggtacgaaagcggggctccccctaaggaggaggcgcgccattaaaaaaacgagagcagccggcggccgcgatgataaaacacacgcgacggtagcgcggacaacaatgcgctgccgaggagaacactggggagagaggcaccacaccggcggggaggcaacacagctgggacacaccaca

SEQ ID NO: 373364 - DNA, 963 bp, Homo sapiens
catcatctttagacttaaggaattaacaagggtcagggagaccccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaaggggggggcggcccaaaaagtttcccccgggggggcccaggtttccgggttccccggttttttttgttaacagagggggtgcccctatattaggaggagcgccggtattaataaggcgtaagggcacgggcgccggccggttttacaacaacgtttcggtcgatgtgtggcacagaccgtggctaacgcgtcgggcactcttgtgggggaaggggacccttcaactttctgggggcgtgtggaccattatttgggggcgcaatctaccccttacgggaagtttttaaacgggccttaagcgggaaaattttacgccttttccaccgtggtagcagcgg

SEQ ID NO: 373365 - DNA, 925 bp, Homo sapiens
  misc_feature (9)..(9): n is a, c, g, or t
gcgcccagngcgtctgtactgacgcgccctcgttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaaggggggggcggcccaaaaagtttcccccgggggggcccaggtttccgggttccccggttttttttgttaacagagggggtgcccctatattaggaggagcgccggtattaataaggcgtaagggcacgggcgccggccggttttacaacaacgtttcggtcgatgtgtggcacagaccgtggctaacgcgtcgggcactcttgtgggggaaggggacccttcaactttctgggggcgtgtggaccattatttgggggcgcaatctaccccttacgggaagtttttaaacgggccttaagcgggaaaattttacgccttttccaccgtggtagcagcgg

SEQ ID NO: 373366 - DNA, 908 bp, Homo sapiens
  misc_feature (7)..(8): n is a, c, g, or t
gcggccnnctactactactaaattcgcggccgcgtcgacttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaaggggggggcggcccaaaaagtttcccccgggggggcccaggtttccgggttccccggttttttttgttaacagagggggtgcccctatattaggaggagcgccggtattaataaggcgtaagggcacgggcgccggccggttttacaacaacgtttcggtcgatgtgtggcacagaccgtggctaacgcgtcgggcactcttgtgggggaaggggacccttcaactttctgggggcgtgtggaccattatttgggggcgcaatctaccccttacgggaagtttttaaacgggccttaagcgggaaaattttacgccttttccaccgtggtagcagcgg

SEQ ID NO: 373367 - DNA, 1149 bp, Homo sapiens
  misc_feature (897)..(897): n is a, c, g, or t
ccacgcgtcgcggacgcgtgggtcgacccacgcgtcgcttcgcggtagctgggaccgccgttcaggtaagaatggggccttggctggatccgaagggcttgtagcaggttggctgcggggtcagaaggcgcggggggaaccgaagaacggggcctgctccgtggccctgctccagtccctatccgaactccttgggaggcctggccttccccacgtgagccgccgcgaccaccatcccgtcgcgatcgtttctggaccgctttccactcccaaatctcctttatcccagagcatttcttggcttctcttacaagccgtcttttctttactcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaaaaaaaaaaacaaaaaaaaacaaaaaaaaaaaaaagaaaaaaaaaaaaaaaaaaaaaaaanagggggggggggccctaaaaaatatccccgcggggggccccagagctaagcgcgcgccaccccacgatgtgtggtacgaaagcggggctccccctaaggaggaggcgcgccattaaaaaaacgagagcagccggcggccgcgatgataaaacacacgcgacggtagcgcggacaacaatgcgctgccgaggagaacactggggagagaggcaccacaccggcggggaggcaacacagctgggacacaccaca

SEQ ID NO: 373368 - DNA, 858 bp, Homo sapiens
  misc_feature (7)..(8): n is a, c, g, or t
  misc_feature (606)..(606): n is a, c, g, or t
gcggccnnctactactactaaattcgcggccgcgtcgatcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaaaaaaaaaaacaaaaaaaaacaaaaaaaaaaaaaagaaaaaaaaaaaaaaaaaaaaaaaanagggggggggggccctaaaaaatatccccgcggggggccccagagctaagcgcgcgccaccccacgatgtgtggtacgaaagcggggctccccctaaggaggaggcgcgccattaaaaaaacgagagcagccggcggccgcgatgataaaacacacgcgacggtagcgcggacaacaatgcgctgccgaggagaacactggggagagaggcaccacaccggcggggaggcaacacagctgggacacaccaca

SEQ ID NO: 373369 - DNA, 934 bp, Homo sapiens
accgcgcggtcgctcagcagacgaggtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcaaaaaaaaaagagaagaaaagaagagaaaggagaaaaaaaacattgcggggggcctttttagcgggggggggaaaacagcggctagaaagaaaaagggcgcccatcgggcagaagaagcgtggccccacggagcccgaagagtgctctctgtaaacaaaacggcgggctacatctgcggaggagatccgcccaccaataggagaagaggcgtgaatgaaaaatggagaggaaaacgacggaggatcacaaccgggctaaaaggaacgcggcaaaacacgacgggacgaagaagcgggaagagacgaaggagaagacaagagagggaacgcacaagggacaacaccaccgtgagagcgaaccac

SEQ ID NO: 373370 - DNA, 819 bp, Homo sapiens
accgcgcggtcgctcagcagacgaggtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcaaaaaaaaaacacagcaacaaaaccagcaaacaccgtggtcggccgcccttgagcccccgcgaaaagttaggcagaaccactcgtggggggcgggggcccaaagggtagcaacccgggtcaaccggatccaaggagacgcggccagactagcgcgggcagctcaccataaaacgccggcgcaccgagcgtcgcaccacccagggagtcgagtcacacggaccatcccggaacacagcacgaataatcc

SEQ ID NO: 373371 - DNA, 924 bp, Homo sapiens
  misc_feature (672)..(672): n is a, c, g, or t
ttactgaactaagtggcttttttattagagaaagccagaattacaaaagacttaagagttggcattggggcccttcttcttgccaaaggtgggcacaacgttgacaaagcgccggttgtactgcatccgccgcttagccggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaaaaaaaaaaacaaaaaaaaacaaaaaaaaaaaaaagaaaaaaaaaaaaaaaaaaaaaaaanagggggggggggccctaaaaaatatccccgcggggggccccagagctaagcgcgcgccaccccacgatgtgtggtacgaaagcggggctccccctaaggaggaggcgcgccattaaaaaaacgagagcagccggcggccgcgatgataaaacacacgcgacggtagcgcggacaacaatgcgctgccgaggagaacactggggagagaggcaccacaccggcggggaggcaacacagctgggacacaccaca

SEQ ID NO: 373372 - DNA, 1512 bp, Homo sapiens
accgcgcggtcgctcagcagacgaggtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtgagtgagagtattagtggtcatggtgttaggactttttttcctttcacagctaaaccaagtccctgggctcttactcggtttgccttctccctccctggagatgagcctgagggaagggatgctaggtgtggaagacaggaaccagggcctgattaaccttcccttctccaggtggccaaacaggagaagaagaagaagacgacaggaagggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaaaaaaaaaaacaaaaaaaaacaaaaaaaaaaaaaagaaaaaaaaaaaaagagggggcgcggcgccgccactaattctactccctccatgggggcgcccccgcttctcgctcccccacaccttttctcggccaaagggggggcgcccccactacagagggggcgcgctaacattcacgcgacacgccgacaccgcggggcgccgccacgataacaacacacacgctctgaggaacggagaagaaaacagccgcgcgacgagggagccacactactgggagaaagaaaacagcccaacactcccctgacgcggggagagcaggaaccaacactagcggggcggcacacaactctcttcctcacctagctagcagatcttttattaagtcgtcacttctagctggggcgtgaacagtaaatacctcacctctccccgtgcggacgtattataacacggagcgctcgaccacacaccacccgccactgcactcgcatctcctccgcgccactcacggcctcctacacacacatccttcgttactcgtctacaccactagacggcgcttgcgtctatctcgtacctccctccactcaacacaccaacaactcctatttccaactcccagcaaaccgcgcgccggtctcctttcacttatctagaacaacaacacctaccccccaccctctacccgactcagaacaccgcctcacaccccgccgta

SEQ ID NO: 373373 - DNA, 1975 bp, Homo sapiens
accgcgcggtcgctcagcagacgaggtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtgagtgagagaggaatgttctttgaagtaccggtaagcgtctagtgagtgtggggtgcatagtcctgacagctgagtgtcacacctatggtaatagagtacttctcactgtcttcagttcagagtgattcttcctgtttacatccctcatgttgaacacagacgtccatgggagactgagccagagtgtagttgtatttcagtcacatcacgagatcctagtctggttatcagcttccacactaaaattaggtcagaccagggcccccaaagtgctctataaaattagaagctggaagatcctgaaatgaaacttaagatttcaaggtcaaatatctgcaactttgttctcattacctattgggcgcagcttctctttaaaggcttgaattgagaaaagaggggttctgctgggtggcaccttcttgctcttacctgctggtgccttcctttcccactacaggtaaagtccatggttccctggcccgtgctggaaaagtgagaggtcagactcctaaggtgagtgagagtattagtggtcatggtgttaggactttttttcctttcacagctaaaccaagtccctgggctcttactcggtttgccttctccctccctggagatgagcctgagggaagggatgctaggtgtggaagacaggaaccagggcctgattaaccttcccttctccaggtggccaaacaggagaagaagaagaagacgacaggaagggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaaaaaaaaaaacaaaaaaaaacaaaaaaaaaaaaaagaaaaaaaaaaaaagagggggcgcggcgccgccactaattctactccctccatgggggcgcccccgcttctcgctcccccacaccttttctcggccaaagggggggcgcccccactacagagggggcgcgctaacattcacgcgacacgccgacaccgcggggcgccgccacgataacaacacacacgctctgaggaacggagaagaaaacagccgcgcgacgagggagccacactactgggagaaagaaaacagcccaacactcccctgacgcggggagagcaggaaccaacactagcggggcggcacacaactctcttcctcacctagctagcagatcttttattaagtcgtcacttctagctggggcgtgaacagtaaatacctcacctctccccgtgcggacgtattataacacggagcgctcgaccacacaccacccgccactgcactcgcatctcctccgcgccactcacggcctcctacacacacatccttcgttactcgtctacaccactagacggcgcttgcgtctatctcgtacctccctccactcaacacaccaacaactcctatttccaactcccagcaaaccgcgcgccggtctcctttcacttatctagaacaacaacacctaccccccaccctctacccgactcagaacaccgcctcacaccccgccgta

SEQ ID NO: 373374 - DNA, 510 bp, Homo sapiens
accgcgcggtcgctcagcagacgaggtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctgggggctaagcggcggatgcagtacaaccggcgctttgtcaacgttgtgcccacctttggcaagaagaagggccccaatgccaactcttaagtcttttgtaattctggctttctctaataaaaaagccacttagttca

SEQ ID NO: 373375 - DNA, 454 bp, Homo sapiens
accgcgcggtcgctcagcagacgaggtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagtggggtgcagaagtgcgcctgggtt

SEQ ID NO: 373376 - DNA, 346 bp, Homo sapiens
  misc_feature (22)..(22): n is a, c, g, or t
  misc_feature (31)..(31): n is a, c, g, or t
  misc_feature (33)..(33): n is a, c, g, or t
  misc_feature (36)..(37): n is a, c, g, or t
aattcgcggccgcgtcgacacngcgcgatangncgnnagaagaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttca

SEQ ID NO: 373377 - DNA, 649 bp, Homo sapiens
  misc_feature (342)..(342): n is a, c, g, or t
  misc_feature (344)..(344): n is a, c, g, or t
  misc_feature (360)..(360): n is a, c, g, or t
  misc_feature (440)..(440): n is a, c, g, or t
  misc_feature (445)..(445): n is a, c, g, or t
  misc_feature (449)..(449): n is a, c, g, or t
  misc_feature (468)..(468): n is a, c, g, or t
gcggccgcctactactactactactgctcgaattcaagcttctaacgatgtacggggataaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaacccgggggntntttttggggggggggnaaaaggggtttgaaggggccggggcttttttttccggccccccttttttttgcaggggggaaatcggggggccccccaanggggngcgncaaaaaatcggcgaagagngcagttgccgcggttatattctccgtgctaaaaaaggagtgagacacgacgagagcgagcagcggaggacaacccactactagacacaaagtgtggctggaaaaccaataacacaagagaaaagcaaatcagagagacaaaagagacgcaccgagacaagagaacaagacacaaccaaaag

SEQ ID NO: 373378 - DNA, 333 bp, Homo sapiens
tggtcatggtgttaggactttttttcctttcacagctaaaccaagtccctgggctcttactcggtttgccttctccctccctggagatgagcctgagggaagggatgctaggtgtggaagacaggaaccagggcctgattaaccttcccttctccaggtggccaaacaggagaagaagaagaagacgacaggaagggctaagcggcggatgcagtacaaccggcgctttgtcaacgttgtgcccacctttggcaagaagaagggccccaatgccaactcttaagtcttttgtaattctggctttctctaataaaaaagccacttagttcagtc

SEQ ID NO: 373379 - DNA, 572 bp, Homo sapiens
accgcgcggtcgctcagcagacgaggtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttca

SEQ ID NO: 373380 - DNA, 575 bp, Homo sapiens
ccccaccccccaccacaccttccggctaggtacgaggactcggttaatcgccgagggagcgcctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttca

SEQ ID NO: 373381 - DNA, 535 bp, Homo sapiens
aggatccttaattaaattaatccccccccccccctcccccgttctttctcgaggcatcttcgcggtagctgggatcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttca

SEQ ID NO: 373382 - DNA, 463 bp, Homo sapiens
ccacgcgtcgcggacgcgtgggtcgacccacgcgtcgggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttca

SEQ ID NO: 373383 - DNA, 1925 bp, Homo sapiens
cattttcattcattcatttaatgaggcttagcaatgatatcaaaagggtcagtctcctgacgttggggagctcacagtacatgcaaatttcttacaaattgaaatacaggttgtcatggaacaatttacagaaggctgtttctatgagggaaataaagggggtgtgccctagggcatcaaagtatatgcaaggggtggccaaggagggtcaccttcccagaaaaggccatacttgaactaaggataaataagaattagccaggcagatagtgtgaaggagggaaaggggtaatacaggaagaaggaattgcactgggcaaagacattttggggctagggagaattctctaaggctggcattttctaagatgtgcatgtggaatgacacaggtaagcctggagagtggacaaagtgctgtagtaccttgtatccaaagccaaggcacgtgggcacagagctgaagctaaggagagtacttcagttctgtaataagggctgtcaggagcagttatctcttgagtaggatctctctgacttcagggaggaaagcaagggtaggaggatgaggtggggctatgggtaatccaggaaggaagtgagcagagtacattcacgtggcagcgctgggcatggaatacagtgtgggtttgacagtgatgttaagatagaaagactggacttcatggctcattgtgtgggagtaagagagaaaggaggtctgcgtgactcccagtttctgggttgggcaactgggttgttaaagagaatacagaggagaattaagtgagcagcttcagagatgacaatgagttgggtttgacattcagagtgcgaaatgcctgaggtcagtcaggcagaatgtctaagtggaagtttgttaatcccaaatctgagatctgagccagagagagttctgagtgtcatttgcagaggagggggctgaggactgactgttgatgagagtgtcccagaagaagagaaagggacaaacctagaatggtgggaaatactgtagggatatggagcaaggaagaggagtccaaaaagaaaacaccagcaacaaagaaaaacagcttaaagaatcaggccgggcgcggtggctcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcaaaaaaaaaagagaagaaaagaagagaaaggagaaaaaaaacattgcggggggcctttttagcgggggggggaaaacagcggctagaaagaaaaagggcgcccatcgggcagaagaagcgtggccccacggagcccgaagagtgctctctgtaaacaaaacggcgggctacatctgcggaggagatccgcccaccaataggagaagaggcgtgaatgaaaaatggagaggaaaacgacggaggatcacaaccgggctaaaaggaacgcggcaaaacacgacgggacgaagaagcgggaagagacgaaggagaagacaagagagggaacgcacaagggacaacaccaccgtgagagcgaaccac

SEQ ID NO: 373384 - DNA, 583 bp, Homo sapiens
  misc_feature (7)..(8): n is a, c, g, or t
gcggccnnctactactactaaattcgcggccgcgtcgacttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcaaaaaaaagtcgacgcggcccggaatttagtagaagttggccgacccggggaattcccgca

SEQ ID NO: 373385 - DNA, 559 bp, Homo sapiens
  misc_feature (7)..(8): n is a, c, g, or t
gcggccnnctactactactaaattcgcggccgcgtcgatcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcaaaaaaaagtcgacgcggcccggaatttagtagaagttggccgacccggggaattcccgca

SEQ ID NO: 373386 - DNA, 709 bp, Homo sapiens
  misc_feature (546)..(547): n is a, c, g, or t
  misc_feature (554)..(554): n is a, c, g, or t
ggggcttttctctcttttcttcgaccttcgctctttcgcgggtaggctggggcaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcaaaaaaaaaaacacaacaccaaacnncaccccnaaccaccacccacaaacaaacctgggggggggccccgggccccaaatcgccctatagtggggcgtaatacaaatcaactgtgcggcgttttacaaccgcgggactgggccccgggtgtacccaactacgccttggagctcccccttttgccgggg

SEQ ID NO: 373387 - DNA, 907 bp, Homo sapiens
ccacgcgtcgcggacgcgtgggtcgacccacgcgtcgcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaaggggggggcggcccaaaaagtttcccccgggggggcccaggtttccgggttccccggttttttttgttaacagagggggtgcccctatattaggaggagcgccggtattaataaggcgtaagggcacgggcgccggccggttttacaacaacgtttcggtcgatgtgtggcacagaccgtggctaacgcgtcgggcactcttgtgggggaaggggacccttcaactttctgggggcgtgtggaccattatttgggggcgcaatctaccccttacgggaagtttttaaacgggccttaagcgggaaaattttacgccttttccaccgtggtagcagcgg

SEQ ID NO: 373388 - DNA, 924 bp, Homo sapiens
  misc_feature (2)..(2): n is a, c, g, or t
  misc_feature (19)..(19): n is a, c, g, or t
tnccgaattcggcagaggnacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaaggggggggcggcccaaaaagtttcccccgggggggcccaggtttccgggttccccggttttttttgttaacagagggggtgcccctatattaggaggagcgccggtattaataaggcgtaagggcacgggcgccggccggttttacaacaacgtttcggtcgatgtgtggcacagaccgtggctaacgcgtcgggcactcttgtgggggaaggggacccttcaactttctgggggcgtgtggaccattatttgggggcgcaatctaccccttacgggaagtttttaaacgggccttaagcgggaaaattttacgccttttccaccgtggtagcagcgg

SEQ ID NO: 373389 - DNA, 991 bp, Homo sapiens
  misc_feature (619)..(621): n is a, c, g, or t
accgcgcggtcgctcagcagacgaggtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcaaaaaaaaaacaacaaaaaacacaaaaaaaaaaacaaaaaaaaaaaannngggggggggccaaaaaaaataccccggggggggcccacatttgggcagtacacccgggtttttttgtacgcagggggggccccataatggggagggcgctataaaaagaagcgaggaacgacgcggggccggtttaacacagccgtgtccgcgcggcgtggcacagcactccgtctcagctggggcactctgggggaaaggcgacacccccataccgccgggggggcgccccctgtgggcaccccacaccacacaagaattgaacgcccgagggcagacaatacaccttcccgtgtgctccggttgggcacccccaccgcatatgtcgtggccgacaagaaatcgccccgggacttgattgaaaataacg

SEQ ID NO: 373390 - DNA, 631 bp, Homo sapiens
accgcgcggtcgctcagcagacgaggtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcaaaaaaaaaaaagaatcaactattaaatgaggaaatttaaaaaaagtttaggttaaaaaa

SEQ ID NO: 373391 - DNA, 746 bp, Homo sapiens
accgcgcggtcgctcagcagacgaggtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtgagtgagagtattagtggtcatggtgttaggactttttttcctttcacagctaaaccaagtccctgggctcttactcggtttgccttctccctccctggagatgagcctgagggaagggatgctaggtgtggaagacaggaaccagggcctgattaaccttcccttctccaggtggccaaacaggagaagaagaagaagacgacaggaagggctaagcggcggatgcagtacaaccggcgctttgtcaacgttgtgcccacctttggcaagaagaagggccccaatgccaactcttaagtcttttgtaattctggctttctctaataaaaaagccacttagttca

SEQ ID NO: 373392 - DNA, 1209 bp, Homo sapiens
accgcgcggtcgctcagcagacgaggtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtgagtgagagaggaatgttctttgaagtaccggtaagcgtctagtgagtgtggggtgcatagtcctgacagctgagtgtcacacctatggtaatagagtacttctcactgtcttcagttcagagtgattcttcctgtttacatccctcatgttgaacacagacgtccatgggagactgagccagagtgtagttgtatttcagtcacatcacgagatcctagtctggttatcagcttccacactaaaattaggtcagaccagggcccccaaagtgctctataaaattagaagctggaagatcctgaaatgaaacttaagatttcaaggtcaaatatctgcaactttgttctcattacctattgggcgcagcttctctttaaaggcttgaattgagaaaagaggggttctgctgggtggcaccttcttgctcttacctgctggtgccttcctttcccactacaggtaaagtccatggttccctggcccgtgctggaaaagtgagaggtcagactcctaaggtgagtgagagtattagtggtcatggtgttaggactttttttcctttcacagctaaaccaagtccctgggctcttactcggtttgccttctccctccctggagatgagcctgagggaagggatgctaggtgtggaagacaggaaccagggcctgattaaccttcccttctccaggtggccaaacaggagaagaagaagaagacgacaggaagggctaagcggcggatgcagtacaaccggcgctttgtcaacgttgtgcccacctttggcaagaagaagggccccaatgccaactcttaagtcttttgtaattctggctttctctaataaaaaagccacttagttca

SEQ ID NO: 373393 - DNA, 2287 bp, Homo sapiens
ccacgcgtcgcggacgcgtgggtcgacccacgcgtcgcttcgcggtagctgggaccgccgttcaggtaagaatggggccttggctggatccgaagggcttgtagcaggttggctgcggggtcagaaggcgcggggggaaccgaagaacggggcctgctccgtggccctgctccagtccctatccgaactccttgggaggcctggccttccccacgtgagccgccgcgaccaccatcccgtcgcgatcgtttctggaccgctttccactcccaaatctcctttatcccagagcatttcttggcttctcttacaagccgtcttttctttactcagtcgccaatatgcagctctttgtccgcgcccaggagctacacaccttcgaggtgaccggccaggaaacggtcgcccagatcaaggtaaggctgcttggtgcgccctgggttccattttcttgtgctcttcactctcgcggcccgagggaacgcttacgagccttatctttccctgtaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtgagtgagagaggaatgttctttgaagtaccggtaagcgtctagtgagtgtggggtgcatagtcctgacagctgagtgtcacacctatggtaatagagtacttctcactgtcttcagttcagagtgattcttcctgtttacatccctcatgttgaacacagacgtccatgggagactgagccagagtgtagttgtatttcagtcacatcacgagatcctagtctggttatcagcttccacactaaaattaggtcagaccagggcccccaaagtgctctataaaattagaagctggaagatcctgaaatgaaacttaagatttcaaggtcaaatatctgcaactttgttctcattacctattgggcgcagcttctctttaaaggcttgaattgagaaaagaggggttctgctgggtggcaccttcttgctcttacctgctggtgccttcctttcccactacaggtaaagtccatggttccctggcccgtgctggaaaagtgagaggtcagactcctaaggtgagtgagagtattagtggtcatggtgttaggactttttttcctttcacagctaaaccaagtccctgggctcttactcggtttgccttctccctccctggagatgagcctgagggaagggatgctaggtgtggaagacaggaaccagggcctgattaaccttcccttctccaggtggccaaacaggagaagaagaagaagacgacaggaagggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaaaaaaaaaaaaaaaaacaaaaaaaaaaaaaaaaaaaaaaaaaacaaaaaaaaacaaaaaaaaaaaaaagaaaaaaaaaaaaagagggggcgcggcgccgccactaattctactccctccatgggggcgcccccgcttctcgctcccccacaccttttctcggccaaagggggggcgcccccactacagagggggcgcgctaacattcacgcgacacgccgacaccgcggggcgccgccacgataacaacacacacgctctgaggaacggagaagaaaacagccgcgcgacgagggagccacactactgggagaaagaaaacagcccaacactcccctgacgcggggagagcaggaaccaacactagcggggcggcacacaactctcttcctcacctagctagcagatcttttattaagtcgtcacttctagctggggcgtgaacagtaaatacctcacctctccccgtgcggacgtattataacacggagcgctcgaccacacaccacccgccactgcactcgcatctcctccgcgccactcacggcctcctacacacacatccttcgttactcgtctacaccactagacggcgcttgcgtctatctcgtacctccctccactcaacacaccaacaactcctatttccaactcccagcaaaccgcgcgccggtctcctttcacttatctagaacaacaacacctaccccccaccctctacccgactcagaacaccgcctcacaccccgccgta

SEQ ID NO: 373394 - DNA, 348 bp, Homo sapiens
  misc_feature (2)..(2): n is a, c, g, or t
  misc_feature (19)..(19): n is a, c, g, or t
  misc_feature (320)..(320): n is a, c, g, or t
  misc_feature (323)..(323): n is a, c, g, or t
  misc_feature (335)..(335): n is a, c, g, or t
tnccgaattcggcagaggnacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaagtcatngtncctgcccctctnaaagtagaggtag

SEQ ID NO: 373395 - DNA, 251 bp, Homo sapiens
tgcccagcaggaggtgcacatgatggcagaaggattctaaacaagggccatgcttctgagtagcggggtgctcctggtgggtgaaggttaggcaccaggttgggggtctctggatgctctttactctctagcaaggccagagaccactagggtccatggccgccctgggtggtgtcctgctctccctgcccggaggacagtgggggctgagatggacacagacatcggagggctgagaaatgagttgctct

SEQ ID NO: 373396 - DNA, 152 bp, Homo sapiens
gaatcccattctttacacctttctcctctggagtcttagttccccattggttattctgtgtcttacatttttggttttcatcatttttgattctccttccccccgctctgtgaatctgctcaacttccttcccttccttccttccctccctt

SEQ ID NO: 373397 - DNA, 501 bp, Homo sapiens
ctcacactggcttggaagagcccatcctcagatctgagtcctgcctctgctggaaagtcctcctgaaggctcagcctcctttttgcatcctcccaaaagccagaagggcagggatgatggtgggaaagttgttggtgaagccaggccgacctgggccagaagccagagcatgtcacacctgcagctgtgtgaccttgggcccaaatgcagtaacaaagccggccttgaaggattgctgcttcaagtaatgggccaaggcagacgagagcactcagcatggccaccttaccactgaaggattcaggcaatggcaggtgatccttggagcccttgcccatgtgcccctctgcaccctaagctgttcctggtcaagatcctcctgtgcccaggaggcagtgagccatttatggccatcctcacaagcatggaggagcactgatgtcctcttacccccaaatcgcccctcctccatggttcctgctctaggggccagccctacag

SEQ ID NO: 373398 - DNA, 293 bp, Homo sapiens
tttttttctgtgggtttctaactttctaaaattcctttggtgtaattttagtagggtttcaggaaagaccagaaataaatgaacatatttaatctaacacatttcatctagttgtatccccaattttagaaaactcatacctacaccaactagttagaatcccaagtgatttacatagcaagaagaaccgaagcttcttctgataggcaaggctataaactccttattgttgagactattaataattaatctctttgtctgcaacatatagccttctacttggttcattgtgg

SEQ ID NO: 373399 - DNA, 513 bp, Homo sapiens
gttgtgattgcctttatgttacatgcatagtcgtatctgtgatatacttggagcctaatctctggtcaagattgcagcattattttcatgggaaaatgtatgccatgacagtgacatgacttctggcctgcagcaataaatgcatcataccaaaactggagaagtgagcatagcccggtgtctgctgcataatcggaattcattcaaagtctgctgaatgagtgaattaattgtctatattctgttcagacacaactacgtggaacatgaaagactgagaactgttctctcaagttccatcataatcgacaacttcagacaagcccctcaactactcgctgtccccatttccttagtaagggctatccatctcataaagatcttaagaagaaaggacatggagcattagtctaaaatgccattctttaaaagtgatatttaggccgggattacaggtgtgagccagccatgcccggcctgtgtcttagtttttagtagaaagtttaaaaagtt

SEQ ID NO: 373400 - DNA, 600 bp, Homo sapiens
gagtgggctgctgatccccctctatattatctattgctgtgtgacagtattaccacaaatacagtagctgaaacaacacatttgttttctcacagtttctgtgggtgaggagttcaagcatagcttggtcctctgcaagcttacaatccaagggttggctcaggctgtattctcatctgagcactctactggggagggtttcaggcttacctgatggttggcggcattcagtccttctagactgtcagactgagggccttggtttttgctggtgcactcagttccttgcttcatatagagtagctcacaatgtagcagcttgtttcactaagacagcaaggaagagtgtttcctagtaagacagacactgtagtcttacctaatacaatcatgaaagtgacatactgtctccttcgccatattctgttagagacaggttacagctttgcccagtggcagtatcctagccaatgaggtttatctgaggcatgattattaaaataattgaaaattttcccaatacaccaaagtgacaacttacaacataggttggcaatggcaatttttgacatgtctacaaagactgaattaaaaaaaaaa

SEQ ID NO: 373401 - DNA, 762 bp, Homo sapiens
aataccttaaatacttcttgactctcttatctttaaggcttagaaggaaaacttcaggtgtgagcccagggtgtgtgctgggggtgggcgtggaggtcctgtggtgtcacggccctccttgtttgcccagggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctggttgggtgactccatgttgtcatggggattttcttcggggtttaaaacaaaaccacgatgagatactgatatagtaaatgacggaagtgggaagggactaccccttttcaggtggaaaacactgtgctgattattcgaccttctttccccacctgggttcctgcagaatgggatgcacagcctgaggttgcctggcgagcatcaggcaagggcgatttggcagctctggagggctggtggctcggggctgtgggcgagtccacaggggtgggtggggcctcctgggcttctgctctcccagactttgtgaaggttcagctgctctcaggcacacctgtcaccagatgtacacgtcacccatggtgggggtccagagggcccaagggctttataaaggggtgaatggagggaggtgtctgtggctggagccccggactctgcccagtgatataacagacagg

SEQ ID NO: 373402 - DNA, 863 bp, Homo sapiens
tgggcttaaagttacttgacttttagatttgtcttctcctgaaaaacagaaataatctcttagagtgatactttttgacagcttgattgcttattaggtcaaccagtgaggttggtagccttaaaacttggcattcattaataatttagtttttctaccactgagaatgataggtagtttattatcttattgtaacttgccatttattttccactacaagtaattgaaaatgttaacatttcttaagggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccagtaagtgggtttgcgttatttttgccattttccaatattacattgtggaggctgaaagacagcccataataagggggttgccaggcccagatggggct

SEQ ID NO: 373403 - DNA, 259 bp, Homo sapiens
ctcagtgggaggccttcacccgacggggtggggccagtcactaatatttctaatgctgcgttttctttttaaccaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccgtcgggtggagcgggtaccgg

SEQ ID NO: 373404 - DNA, 7786 bp, Homo sapiens
tgggcttaaagttacttgacttttagatttgtcttctcctgaaaaacagaaataatctcttagagtgatactttttgacagcttgattgcttattaggtcaaccagtgaggttggtagccttaaaacttggcattcattaataatttagtttttctaccactgagaatgataggtagtttattatcttattgtaacttgccatttattttccactacaagtaattgaaaatgttaacatttcttaagggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtaactttttccctcttgtgcttgctttgttatactctctggtggagtctctagtcaagaggacctaatttgatatacataaccacagccgggatagaagtgtgactgaacaagtttgaactccttccttttccctttggtctgctcagggtggtgctataaatccagtttttacaatgttagccccagagagcaagacgcctagcagtgaaaagctcttgtcttaggcagaaattgaaatggcaatttgtggccaggcatggcggctcatgcctgtaattccagcactttgggaggccaaggcggccagatcacctgaggtcaggagtttgagaccagcctggcgagtgaaaccccgtctctactaaaaaaaaattagccgggcgtggtggtgcacgcctgtagtcccagctccttaggaggctaaggcaggagaattgcttaaacacgggaggcagaggttgcagtaagctgagatgacgccactgctctctggcctgggagacagagtgagactccatctcagaaagaaaaaaaaaaaaaggcaatttgataagtaaaacattgatggatttcagttagctcttcctgctgaaatacaggtaggattctaaaataatgttggctggtcttgtttatgccttattatatttgactcattttttaggtgcaattttgctaaaaatgcacctttttagtagattcttaaaaatggccatgtcctgggttttgtagagtctagaaaagaccccaaacactcttcccatgtgttggcctctgagcctgccttggaaacctgtgtgtgccagagcacacaggcaggccgggccagtgtcacatctctaaaggtcaccctatcctcactttcttacgtcctggtcagcagaagagcagagttcagacatactccttcatggaagcgctgcagtcgacaaatgtgttccttcatggttcaccttcagttttaagacgacagggttctgggcggacatagcgtttagttttcgcttttcctgttgtaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggttgttcagtttctgcaaaaaaatggcaaagagctctcatgtgagaactaccttaatttatatgccaaagctggtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatcta

SEQ ID NO: 373405 - DNA, 7357 bp, Homo sapiens
tgggcttaaagttacttgacttttagatttgtcttctcctgaaaaacagaaataatctcttagagtgatactttttgacagcttgattgcttattaggtcaaccagtgaggttggtagccttaaaacttggcattcattaataatttagtttttctaccactgagaatgataggtagtttattatcttattgtaacttgccatttattttccactacaagtaattgaaaatgttaacatttcttaagggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccagagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtaactttttccctcttgtgcttgctttgttatactctctggtggagtctctagtcaagaggacctaatttgatatacataaccacagccgggatagaagtgtgactgaacaagtttgaactccttccttttccctttggtctgctcagggtggtgctataaatccagtttttacaatgttagccccagagagcaagacgcctagcagtgaaaagctcttgtcttaggcagaaattgaaatggcaatttgtggccaggcatggcggctcatgcctgtaattccagcactttgggaggccaaggcggccagatcacctgaggtcaggagtttgagaccagcctggcgagtgaaaccccgtctctactaaaaaaaaattagccgggcgtggtggtgcacgcctgtagtcccagctccttaggaggctaaggcaggagaattgcttaaacacgggaggcagaggttgcagtaagctgagatgacgccactgctctctggcctgggagacagagtgagactccatctcagaaagaaaaaaaaaaaaaggcaatttgataagtaaaacattgatggatttcagttagctcttcctgctgaaatacaggtaggattctaaaataatgttggctggtcttgtttatgccttattatatttgactcattttttaggtgcaattttgctaaaaatgcacctttttagtagattcttaaaaatggccatgtcctgggttttgtagagtctagaaaagaccccaaacactcttcccatgtgttggcctctgagcctgccttggaaacctgtgtgtgccagagcacacaggcaggccgggccagtgtcacatctctaaaggtcaccctatcctcactttcttacgtcctggtcagcagaagagcagagttcagacatactccttcatggaagcgctgcagtcgacaaatgtgttccttcatggttcaccttcagttttaagacgacagggttctgggcggacatagcgtttagttttcgcttttcctgttgtaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggttgttcagtttctgcaaaaaaatggcaaagagctctcatgtgagaactaccttaatttatatgccaaagctggtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatcta

SEQ ID NO: 373406 - DNA, 2925 bp, Homo sapiens
tggtaccccagtccgttcgactgagccacggttctctcactgacatttctctctgacgggtgctctttgtcctgtaggtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatcta

SEQ ID NO: 373407 - DNA, 3694 bp, Homo sapiens
cttgattctttctgtaaacctttattaaatccctatatgccaggtgagtaagtttcaggctgtaactctagaaaggtgttggttaatgggagagtcaagacccccaagcaggcaactagtcagggcggtcagggcagtgggcgcgctgaggagggccgtgtcagggcccacttcccaagcctggggagcctgttgcaaaaccttcaaggatgtgcctgagggaagcacgtgacaaggaggggagagagcattctgggcaaaggggatgatgacatgagcagatgcagggttgtgacaagtggcatggagtgtcgagaggctaagagggagctgagagctcggttagggagggcgtggctcctccaggtaaggagggaggactgtgttggagagagctggagcccaggtttgcatttgaaaagcaccccagtggtgctgtccatggtagagccgagagaagcaggcatggagaagggaactgggctaggatcctggccactgcagaggtctgggtcagtgttagatggagggattgagccagagtaaaaatagtagaatagaggaagtaggaaggacccaggcaaagcttgcctgggagctgagatcagtgacctggcgacggtgtgcacatgtagggggcctgggagcctagctccactactaccactctgcttggctgagatggagagcggcaccatcagggagaggactttaagatgctgataatgaacttagtttaaagggtctgagagattgctcttaattcttaggtggttgttcagtttctgcaaaaaaatggcaaagagctctcatgtgagaactaccttaatttatatgccaaagctggtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatcta

SEQ ID NO: 373408 - DNA, 3676 bp, Homo sapiens
cttgattctttctgtaaacctttattaaatccctatatgccaggtgagtaagtttcaggctgtaactctagaaaggtgttggttaatgggagagtcaagacccccaagcaggcaactagtcagggcggtcagggcagtgggcgcgctgaggagggccgtgtcagggcccacttcccaagcctggggagcctgttgcaaaaccttcaaggatgtgcctgagggaagcacgtgacaaggaggggagagagcattctgggcaaaggggatgatgacatgagcagatgcagggttgtgacaagtggcatggagtgtcgagaggctaagagggagctgagagctcggttagggagggcgtggctcctccaggtaaggagggaggactgtgttggagagagctggagcccaggtttgcatttgaaaagcaccccagtggtgctgtccatggtagagccgagagaagcaggcatggagaagggaactgggctaggatcctggccactgcagaggtctgggtcagtgttagatggagggattgagccagagtaaaaatagtagaatagaggaagtaggaaggacccaggcaaagcttgcctgggagctgagatcagtgacctggcgacggtgtgcacatgtagggggctactaccactctgcttggctgagatggagagcggcaccatcagggagaggactttaagatgctgataatgaacttagtttaaagggtctgagagattgctcttaattcttaggtggttgttcagtttctgcaaaaaaatggcaaagagctctcatgtgagaactaccttaatttatatgccaaagctggtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatcta

SEQ ID NO: 373409 - DNA, 2852 bp, Homo sapiens
aataccttaaatacttcttgactctcttatctttaaggcttagaaggaaaacttcaggtgtgagcccagggtgtgtgctgggggtgggcgtggaggtcctgtggtgtcacggccctccttgtttgcccagggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatcta

SEQ ID NO: 373410 - DNA, 3371 bp, Homo sapiens
cctggcttgctcaggtctgggtcagtgttagatggagggattgagccagagtaaaaatagtagacctgaggaggactgtgttggagagagctggagcccaggtttgcatttgaaaagcaccccagtggtgctgtccatggtagagccgagagaagcaggcatggagaagggaactgggctaggatcctggccactgcagaggtctgggtcagtgttagatggagggattgagccagagtaaaaatagtagaatagaggaagtaggaaggacccaggcaaagcttgcctgggagctgagatcagtgacctggcgacggtgtgcacatgtagggggctactaccactctgcttggctgagatggagagcggcaccatcagggagaggactttaagatgctgataatgaacttagtttaaagggtctgagagattgctcttaattcttaggtggttgttcagtttctgcaaaaaaatggcaaagagctctcatgtgagaactaccttaatttatatgccaaagctggtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatcta

SEQ ID NO: 373411 - DNA, 3213 bp, Homo sapiens
ctcagtgggaggccttcacccgacggggtggggccagtcactaatatttctaatgctgcgttttctttttaaccaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggttgttcagtttctgcaaaaaaatggcaaagagctctcatgtgagaactaccttaatttatatgccaaagctggtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatcta

SEQ ID NO: 373412 - DNA, 5696 bp, Homo sapiens
tgggcttaaagttacttgacttttagatttgtcttctcctgaaaaacagaaataatctcttagagtgatactttttgacagcttgattgcttattaggtcaaccagtgaggttggtagccttaaaacttggcattcattaataatttagtttttctaccactgagaatgataggtagtttattatcttattgtaacttgccatttattttccactacaagtaattgaaaatgttaacatttcttaagggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtaactttttccctcttgtgcttgctttgttatactctctggtggagtctctagtcaagaggacctaatttgatatacataaccacagccgggatagaagtgtgactgaacaagtttgaactccttccttttccctttggtctgctcagggtggtgctataaatccagtttttacaatgttagccccagagagcaagacgcctagcagtgaaaagctcttgtcttaggcagaaattgaaatggcaatttgtggccaggcatggcggctcatgcctgtaattccagcactttgggaggccaaggcggccagatcacctgaggtcaggagtttgagaccagcctggcgagtgaaaccccgtctctactaaaaaaaaattagccgggcgtggtggtgcacgcctgtagtcccagctccttaggaggctaaggcaggagaattgcttaaacacgggaggcagaggttgcagtaagctgagatgacgccactgctctctggcctgggagacagagtgagactccatctcagaaagaaaaaaaaaaaaaggcaatttgataagtaaaacattgatggatttcagttagctcttcctgctgaaatacaggtaggattctaaaataatgttggctggtcttgtttatgccttattatatttgactcattttttaggtgcaattttgctaaaaatgcacctttttagtagattcttaaaaatggccatgtcctgggttttgtagagtctagaaaagaccccaaacactcttcccatgtgttggcctctgagcctgccttggaaacctgtgtgtgccagagcacacaggcaggccgggccagtgtcacatctctaaaggtcaccctatcctcactttcttacgtcctggtcagcagaagagcagagttcagacatactccttcatggaagcgctgcagtcgacaaatgtgttccttcatggttcaccttcagttttaagacgacagggttctgggcggacatagcgtttagttttcgcttttcctgttgtaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggttgttcagtttctgcaaaaaaatggcaaagagctctcatgtgagaactaccttaatttatatgccaaagctggtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctggttgggtgactccatgttgtcatggggattttcttcggggtttaaaacaaaaccacgatgagatactgatatagtaaatgacggaagtgggaagggactaccccttttcaggtggaaaacactgtgctgattattcgaccttctttccccacctgggttcctgcagaatgggatgcacagcctgaggttgcctggcgagcatcaggcaagggcgatttggcagctctggagggctggtggctcggggctgtgggcgagtccacaggggtgggtggggcctcctgggcttctgctctcccagactttgtgaaggttcagctgctctcaggcacacctgtcaccagatgtacacgtcacccatggtgggggtccagagggcccaagggctttataaaggggtgaatggagggaggtgtctgtggctggagccccggactctgcccagtgatataacagacagg

SEQ ID NO: 373413 - DNA, 3503 bp, Homo sapiens
tgggcttaaagttacttgacttttagatttgtcttctcctgaaaaacagaaataatctcttagagtgatactttttgacagcttgattgcttattaggtcaaccagtgaggttggtagccttaaaacttggcattcattaataatttagtttttctaccactgagaatgataggtagtttattatcttattgtaacttgccatttattttccactacaagtaattgaaaatgttaacatttcttaagggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtaactttttccctcttgtgcttgctttgttatactctctggtggagtctctagtcaagaggacctaatttgatatacataaccacagccgggatagaagtgtgactgaacaagtttgaactccttccttttccctttggtctgctcagggtggtgctataaatccagtttttacaatgttagccccagagagcaagacgcctagcagtgaaaagctcttgtcttaggcagaaattgaaatggcaatttgtggccaggcatggcggctcatgcctgtaattccagcactttgggaggccaaggcggccagatcacctgaggtcaggagtttgagaccagcctggcgagtgaaaccccgtctctactaaaaaaaaattagccgggcgtggtggtgcacgcctgtagtcccagctccttaggaggctaaggcaggagaattgcttaaacacgggaggcagaggttgcagtaagctgagatgacgccactgctctctggcctgggagacagagtgagactccatctcagaaagaaaaaaaaaaaaaggcaatttgataagtaaaacattgatggatttcagttagctcttcctgctgaaatacaggtaggattctaaaataatgttggctggtcttgtttatgccttattatatttgactcattttttaggtgcaattttgctaaaaatgcacctttttagtagattcttaaaaatggccatgtcctgggttttgtagagtctagaaaagaccccaaacactcttcccatgtgttggcctctgagcctgccttggaaacctgtgtgtgccagagcacacaggcaggccgggccagtgtcacatctctaaaggtcaccctatcctcactttcttacgtcctggtcagcagaagagcagagttcagacatactccttcatggaagcgctgcagtcgacaaatgtgttccttcatggttcaccttcagttttaagacgacagggttctgggcggacatagcgtttagttttcgcttttcctgttgtaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgaggtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgaggtgaaccatctcaaagcctttgtcgatataatgccctagttctgctttttataggaagcctgccctttctgcccacatctctttacaaataagtactctacaatgcttcatcctcatgtgtttagccttcagtcaaagtacagtcatgcaccacataacaaaattttggccaaccatggactgtatataggacagtggtcccataagattataatcacatattttcactagacctttcgatgattagatacacaaataccattgtgttata

SEQ ID NO: 373414 - DNA, 2136 bp, Homo sapiens
tgggcttaaagttacttgacttttagatttgtcttctcctgaaaaacagaaataatctcttagagtgatactttttgacagcttgattgcttattaggtcaaccagtgaggttggtagccttaaaacttggcattcattaataatttagtttttctaccactgagaatgataggtagtttattatcttattgtaacttgccatttattttccactacaagtaattgaaaatgttaacatttcttaagggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctagcaggagtatgtctccaaaccttttaaacagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgaggtaagaaacaagcaagctgtttatttcaggaaataacatttgacccagaaacaattttagaaataataaaaatagattcaatcacattcccacccccttgtgatgattgcatgtggaataatgcttattctagattgatacagttagaaacaagccatttgactcttgtctaagtcattaatcaaagctggaatacagcttaaacttgacaggcacttgggagtaaaataatacgcaacatgttcaaataggt

SEQ ID NO: 373415 - DNA, 1727 bp, Homo sapiens
tgggcttaaagttacttgacttttagatttgtcttctcctgaaaaacagaaataatctcttagagtgatactttttgacagcttgattgcttattaggtcaaccagtgaggttggtagccttaaaacttggcattcattaataatttagtttttctaccactgagaatgataggtagtttattatcttattgtaacttgccatttattttccactacaagtaattgaaaatgttaacatttcttaagggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaagtgaagagtgttgagctcagcccccacagagagagcgtcggtaccagctatata

SEQ ID NO: 373416 - DNA, 363 bp, Homo sapiens
ttaccttgtgctcagtattaataatttttaaagtttaagttaattttcaaatttgagtctccccaacatatttgctcctttttaatactgaaagtaacatatgtgtcttggaattcttttggtaagattgtcttacattcttctgatgtgaaacgtgtttctttcctaagaaacgggggaagcaattttgaatatagtccagcctttcctttcttctcagtgggtgtcaatagagttgtctgtctttgtcaagtgtttctaatgtttggggatggggttggtctgtaccttttctttcagctgatgtcaattttgcattggaacttagtgacctgagacacaggcatggtttccacattattt

SEQ ID NO: 373417 - DNA, 389 bp, Homo sapiens
tgcagaaacaatgtctgttcttcaggatgcccctgcctgttgcctgcctctgtttaaatttacagatatctatgaaaaaaaagtaagttaggtatattttttctttatccagtcagtactgattggtggcttacatgcacaaaaccatggtaatgactcttgaggaacttcagcctggtagaggagaggagacagagacactggcattcagatttacatgtcaatgaatgtttagcagacagttttaaaacgtcttttatttttaacaaagttagacctttggtcctcagtgttgtgcttatttttcccctaattgactagctttagtttgttttttttgtttgtttgtttgttttttaatttttttggagacagagtctcgctctgtt

SEQ ID NO: 373418 - DNA, 6749 bp, Homo sapiens
tgggcttaaagttacttgacttttagatttgtcttctcctgaaaaacagaaataatctcttagagtgatactttttgacagcttgattgcttattaggtcaaccagtgaggttggtagccttaaaacttggcattcattaataatttagtttttctaccactgagaatgataggtagtttattatcttattgtaacttgccatttattttccactacaagtaattgaaaatgttaacatttcttaagggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggtctggataaaaggacatggtcataagagaattgtagtgttaaaaaatgacatgaaaagtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatcta

SEQ ID NO: 373419 - DNA, 6374 bp, Homo sapiens
tgggcttaaagttacttgacttttagatttgtcttctcctgaaaaacagaaataatctcttagagtgatactttttgacagcttgattgcttattaggtcaaccagtgaggttggtagccttaaaacttggcattcattaataatttagtttttctaccactgagaatgataggtagtttattatcttattgtaacttgccatttattttccactacaagtaattgaaaatgttaacatttcttaagggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttgagaaaaaagataaagaggagactgtattccaagtgagttacccgtctgcttttagcaagttagttgcatccaggcaagtcagtcctctgctcgcatctcagtcttggtcttctagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgaggtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgagaccgctgcagccttcgacttgcaaatagaactgaagtttgctggaggctatagccttctcttggaggaaatccttgaatatatccctcctccttttctttctcctcttccttctttccttcctcctcctcctttcttcttctttgtcttttttgtcatcttcatcttcttcatctttgtctttgtccaattcgtcgtcttcgtcttctttatcgtcgtcttcgtcttcttcatcgtcgtcttcgttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggttgttcagtttctgcaaaaaaatggcaaagagctctcatgtgagaactaccttaatttatatgccaaagctggtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatcta

SEQ ID NO: 373420 - DNA, 6794 bp, Homo sapiens
tgggcttaaagttacttgacttttagatttgtcttctcctgaaaaacagaaataatctcttagagtgatactttttgacagcttgattgcttattaggtcaaccagtgaggttggtagccttaaaacttggcattcattaataatttagtttttctaccactgagaatgataggtagtttattatcttattgtaacttgccatttattttccactacaagtaattgaaaatgttaacatttcttaagggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctagcaggagtatgtctccaaaccttttaaacagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggttgttcagtttctgcaaaaaaatggcaaagagctctcatgtgagaactaccttaatttatatgccaaagctggtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatcta

SEQ ID NO: 373421 - DNA, 5307 bp, Homo sapiens
taatgtcaatatgtgtgttttaagcaggagtatgtctccaaaccttttaaacagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggttgttcagtttctgcaaaaaaatggcaaagagctctcatgtgagaactaccttaatttatatgccaaagctggtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatcta

SEQ ID NO: 373422 - DNA, 8002 bp, Homo sapiens
tgggcttaaagttacttgacttttagatttgtcttctcctgaaaaacagaaataatctcttagagtgatactttttgacagcttgattgcttattaggtcaaccagtgaggttggtagccttaaaacttggcattcattaataatttagtttttctaccactgagaatgataggtagtttattatcttattgtaacttgccatttattttccactacaagtaattgaaaatgttaacatttcttaagggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtaactttttccctcttgtgcttgctttgttatactctctggtggagtctctagtcaagaggacctaatttgatatacataaccacagccgggatagaagtgtgactgaacaagtttgaactccttccttttccctttggtctgctcagggtggtgctataaatccagtttttacaatgttagccccagagagcaagacgcctagcagtgaaaagctcttgtcttaggcagaaattgaaatggcaatttgtggccaggcatggcggctcatgcctgtaattccagcactttgggaggccaaggcggccagatcacctgaggtcaggagtttgagaccagcctggcgagtgaaaccccgtctctactaaaaaaaaattagccgggcgtggtggtgcacgcctgtagtcccagctccttaggaggctaaggcaggagaattgcttaaacacgggaggcagaggttgcagtaagctgagatgacgccactgctctctggcctgggagacagagtgagactccatctcagaaagaaaaaaaaaaaaaggcaatttgataagtaaaacattgatggatttcagttagctcttcctgctgaaatacaggtaggattctaaaataatgttggctggtcttgtttatgccttattatatttgactcattttttaggtgcaattttgctaaaaatgcacctttttagtagattcttaaaaatggccatgtcctgggttttgtagagtctagaaaagaccccaaacactcttcccatgtgttggcctctgagcctgccttggaaacctgtgtgtgccagagcacacaggcaggccgggccagtgtcacatctctaaaggtcaccctatcctcactttcttacgtcctggtcagcagaagagcagagttcagacatactccttcatggaagcgctgcagtcgacaaatgtgttccttcatggttcaccttcagttttaagacgacagggttctgggcggacatagcgtttagttttcgcttttcctgttgtaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggttgttcagtttctgcaaaaaaatggcaaagagctctcatgtgagaactaccttaatttatatgccaaagctggtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatctaaaaaaagacaaaaaatgcaaagcacagcacaggcgcgagagccgcccgcgcgagccagcaccgggacacccagacgacgactccacacgccacacaccaggacccgggcgaaaacctaccaggagacacaaccacgtgtgagcgcgccccgagtgcaaaacagcgcacacacaggaacaccgctaaacccggtacaacacaagcggaatgtgcacg

SEQ ID NO: 373423 - DNA, 4786 bp, Homo sapiens
tgggcttaaagttacttgacttttagatttgtcttctcctgaaaaacagaaataatctcttagagtgatactttttgacagcttgattgcttattaggtcaaccagtgaggttggtagccttaaaacttggcattcattaataatttagtttttctaccactgagaatgataggtagtttattatcttattgtaacttgccatttattttccactacaagtaattgaaaatgttaacatttcttaagggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtaactttttccctcttgtgcttgctttgttatactctctggtggagtctctagtcaagaggacctaatttgatatacataaccacagccgggatagaagtgtgactgaacaagtttgaactccttccttttccctttggtctgctcagggtggtgctataaatccagtttttacaatgttagccccagagagcaagacgcctagcagtgaaaagctcttgtcttaggcagaaattgaaatggcaatttgtggccaggcatggcggctcatgcctgtaattccagcactttgggaggccaaggcggccagatcacctgaggtcaggagtttgagaccagcctggcgagtgaaaccccgtctctactaaaaaaaaattagccgggcgtggtggtgcacgcctgtagtcccagctccttaggaggctaaggcaggagaattgcttaaacacgggaggcagaggttgcagtaagctgagatgacgccactgctctctggcctgggagacagagtgagactccatctcagaaagaaaaaaaaaaaaaggcaatttgataagtaaaacattgatggatttcagttagctcttcctgctgaaatacaggtaggattctaaaataatgttggctggtcttgtttatgccttattatatttgactcattttttaggtgcaattttgctaaaaatgcacctttttagtagattcttaaaaatggccatgtcctgggttttgtagagtctagaaaagaccccaaacactcttcccatgtgttggcctctgagcctgccttggaaacctgtgtgtgccagagcacacaggcaggccgggccagtgtcacatctctaaaggtcaccctatcctcactttcttacgtcctggtcagcagaagagcagagttcagacatactccttcatggaagcgctgcagtcgacaaatgtgttccttcatggttcaccttcagttttaagacgacagggttctgggcggacatagcgtttagttttcgcttttcctgttgtaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtcaaggtcatgaatccatattcacaggggttaaggggagtgttgtgggtactttcgtgtcgacgc

SEQ ID NO: 373424 - DNA, 2190 bp, Homo sapiens
tgggcttaaagttacttgacttttagatttgtcttctcctgaaaaacagaaataatctcttagagtgatactttttgacagcttgattgcttattaggtcaaccagtgaggttggtagccttaaaacttggcattcattaataatttagtttttctaccactgagaatgataggtagtttattatcttattgtaacttgccatttattttccactacaagtaattgaaaatgttaacatttcttaagggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctagcaggagtatgtctccaaaccttttaaacagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagttggcacagtgatgtgtcagatctatataaattacagacacgtcgcatcggaccagaagacgtgggtgttctaccgagtcaggcgcaagcctgggtttcagtaacgaggtcccagaatgggcactttgaagtgattcggcgtggaggtgcaagtggggggggtcaaatttaagggggggaggaaaaccgggaagtttgagccaaaagtgggggggccttggtgaa

SEQ ID NO: 373425 - DNA, 1574 bp, Homo sapiens
cgagccagtggagggcggtgggggcggggcaagcgcggaggaccaggaccggctccggaccgcgcagttagcgccgcctggcctgggccggacccggtcagggttctcaagctgtcgtccctatggggctgtgttttccttgtcccggggagtccgcgcctcccacgccggacctggaagagaaaagagcaaagcttgcagaggctgcagagagaagacaaaaagaggctgcatctcggggaattttagatgttcaatctgtgcaagaaaagagaaagaaaaaggaaaaaatagaaaaacaaattgctacatccgggcccccaccagaaggtggacttaggtggacagtttcataaagcataacatgagtagaagaatctactgccaataactgtttattatctgcaatcaagtgggcttcatcaatttaatttcttctctttgagtaaatgaagattcagactttgtaatattattgcccttaagtgcaatgctaaaaaaacgttgattttcaagcttagagaatggctagacttttcattaaatactgattttcctacatttgctcttctgcagttagtgggtgatttgctatttttcttagtagttaaaaaatggaactaaatagtgaatatacatacactgcatgtaaacattctgcatatacctctaagattaaaattcgcagttgtcttttcatcctttataaaatgatctaactacttatatttgtgctgcatcgcgttacatctgtttttatttcactatgaagatgtttgattaaacttatggacttagtgcctttaaactgatcatcagggagaatcttgaaaaaatcatttgaagggctgatgtgaaggagcactgtaaatttttataacttagtaatgagtattcttaggcagatgtaaaattttttccaatttatttttatttatgtagcttataaaattaacataccctgttttactttatgataaaggattttttgtttgctgaatttaaaattatatattagtgataccatcagagggcagtgatgttctattgtatattaaattcagctctgtaaggatctttgtagtaattgaatgagttaaactaataatctggatgggttataatgagtagtaatatatttgtccatatttcataagtagtgttaatcttgtgtacttattagagaacgatcataagatttatacagatgtgaaactgcgaaggcaagtatgaatgtatgaaaaaaacatgtaggtactgtacttacaaaaggtctacttcagatataaaaatattaggtaattctatacaatgcatagtcataaaccttaacatttttgttcattagaaacatgaattttatagcattttttgtttctcctatataatacactgaaataaaagaatttgtgttagctattaaggctgatagctcttttaaatggcaaggccacatgttgagccctaaattaaaatttgcagatattaagtgctaatagaaattttaagttaaatcgaccaagttcacttgctttacacaaaggaaactgagccactatcttcatctacccctc

SEQ ID NO: 373426 - DNA, 725 bp, Homo sapiens
cgagccagtggagggcggtgggggcggggcaagcgcggaggaccaggaccggctccggaccgcgcagttagcgccgcctggcctgggccggacccggtcagggttctcaagctgtcgtccctatggggctgtgttttccttgtcccggggagtccgcgcctcccacgccggacctggaagagaaaagagcaaagcttgcagaggctgcagagagaagacaaaaagaggctgcatctcggggaattttagatgttcaatctgtgcaagaaaagagaaagaaaaaggaaaaaatagaaaaacaaattgctacatccgggcccccaccagaaggtggacttaggtggacagtttcataaagcataacatgagtagaagaatctactgccaataactgtttattatctgcaatcaagtgggcttcatcaatttaatttcttctctttgagtaaatgaagattcagactttgtaatattattgcccttaagtgcaatgctaaaaaaacgttgattttcaagcttagagaatggctagacttttcattaaatactgattttcctacatttgctcttctgcagttagtgggtgatttgctatttttcttagtagttaaaaaatggaactaaatagtgaatatacatacactgcatgtaaacattctgcatatacctctaagattaaaattcgcagttgtcttttcatcctttataaaatgatctaactactt

SEQ ID NO: 373427 - DNA, 1675 bp, Homo sapiens
gcgaggacgggtggacgcgtcaggagggtcgttgggtcctgtcagagcgacctaggccgtcgcctccgtgtagatctccacttttgtaacaaaaagttgtcgaaaggcggctgtggcgtctttctaccttccactgactttagctgcgccggatcttcatagggcgccggcgcacgcagagggcgttacgcgtgggacattccgggggatgtggtagatggaattcggcgcgaaaagacattgctttctccgggagctctttagtcgtctaggagatgaagagaaaagagcaaagcttgcagaggctgcagagagaagacaaaaagaggctgcatctcggggaattttagatgttcaatctgtgcaagaaaagagaaagaaaaaggaaaaaatagaaaaacaaattgctacatccgggcccccaccagaaggtggacttaggtggacagtttcataaagcataacatgagtagaagaatctactgccaataactgtttattatctgcaatcaagtgggcttcatcaatttaatttcttctctttgagtaaatgaagattcagactttgtaatattattgcccttaagtgcaatgctaaaaaaacgttgattttcaagcttagagaatggctagacttttcattaaatactgattttcctacatttgctcttctgcagttagtgggtgatttgctatttttcttagtagttaaaaaatggaactaaatagtgaatatacatacactgcatgtaaacattctgcatatacctctaagattaaaattcgcagttgtcttttcatcctttataaaatgatctaactacttatatttgtgctgcatcgcgttacatctgtttttatttcactatgaagatgtttgattaaacttatggacttagtgcctttaaactgatcatcagggagaatcttgaaaaaatcatttgaagggctgatgtgaaggagcactgtaaatttttataacttagtaatgagtattcttaggcagatgtaaaattttttccaatttatttttatttatgtagcttataaaattaacataccctgttttactttatgataaaggattttttgtttgctgaatttaaaattatatattagtgataccatcagagggcagtgatgttctattgtatattaaattcagctctgtaaggatctttgtagtaattgaatgagttaaactaataatctggatgggttataatgagtagtaatatatttgtccatatttcataagtagtgttaatcttgtgtacttattagagaacgatcataagatttatacagatgtgaaactgcgaaggcaagtatgaatgtatgaaaaaaacatgtaggtactgtacttacaaaaggtctacttcagatataaaaatattaggtaattctatacaatgcatagtcataaaccttaacatttttgttcattagaaacatgaattttatagcattttttgtttctcctatataatacactgaaataaaagaatttgtgttagctattaaggctgatagctcttttaaatggcaaggccacatgttgagccctaaattaaaatttgcagatattaagtgctaatagaaattttaagttaaatcgaccaagttcacttgctttacacaaaggaaactgagccactatcttcatctacccctc

SEQ ID NO: 373428 - DNA, 589 bp, Homo sapiens
gtttcatgtgaaatttctagtttaatatgtcctcttttctagaaacagaaagacaagcttgcagaggctgcagcagagaagacaaaaagaggctgcatctcggggaattttagatgttcaatctgtgcaagaaaagagaaagaaaaaggaaaaaatagaaaaacaaattgctacatccgggcccccaccagaaggtggacttaggtggacagtttcataaagcataacatgagtagaagaatctactgccaataactgtttattatctgcaatcaagtgggcttcatcaatttaatttcttctctttgagtaaatgaagattcagactttgtaatattattgcccttaagtgcaatgctaaaaaaacgttgattttcaagcttagagaatggctagacttttcattaaatactgattttcctacatttgctcttctgcagttagtgggtgatttgctatttttcttagtagttaaaaaatggaactaaatagtgaatatacatacactgcatgtaaacattctgcatatacctctaagattaaaattcgcagttgtcttttcatcctttataaaatgatctaactactt

SEQ ID NO: 373429 - DNA, 665 bp, Homo sapiens
gtccttctttggatcttacatctagctgagaataaggtgacattaacctacttggtctatgtcctggccagtcttcaataaggagttgaggagtaagaggctgaatatagtctcagtttttttcacatccctggttggtgccgattgactagcagctagactccagtgccagttgtgaccatgttttcagtgacacttaaaagaccatcttagatgtggtatgggtatcataatccttccctccctgccaaacatgttcatgtcctaatccctggaagctgtgaatatgttgttacatggcaaagtcgattctttagatgtgcctcaagttagtgaccttaaaatagattatccaggtagatccaagctaatcatgtgattgttaaaagcagaaaacctttccaacctatgagagaaagagatgtgaagaaagaagacgggtcatagagatgctacattgctgattttgaagatggaggaaggaaatcatggagcttaggaatgcaggtggcctctagaagatggaaaaggaaaggaaatggatgctcccctagactcttcaggaaggaaaacagccttggtgacactctgattttagcctattgaaaccatgttgaatgactgcagaaatgtgagataataaacatgcttattcagctaccaag

SEQ ID NO: 373430 - DNA, 395 bp, Homo sapiens
  misc_feature (35)..(35): n is a, c, g, or t
cggccgctccaacatctaaaattccccgagatgcncctctttttgtcttctctctgcagcatgttcaatctgtgcaagaaaagagaaagaaaaaggaaaaaatagaaaaacaaattgctacatccgggcccccaccagaaggtggacttaggtggacagtttcataaagcataacatgagtagaagaatctactgccaataactgtttattatctgcaatcaagtgggcttcatcaatttaatttcttctctttgagtaaatgaagattcagactttgtaatattattgcccttaagtgcaatgctaaaaaaacgttgattttcaagcttagagaatggctagacttttcattaaatactgattttcctaaaaaaaaaactcgtgccgaattctt

SEQ ID NO: 373431 - DNA, 1628 bp, Homo sapiens
gtaatagagagctcgctctgccacctggaagtatgggctggagacacatttggccaactgccggaagaggggttccatgatcttcacaaattctgatggttcctcgtgccgggacgcgcagttagcgccgcctggcctgggccggacccggtcagggttctcaagctgtcgtccctatggggctgtgttttccttgtcccggggagtccgcgcctcccacgccggacctggaagagaaaagagcaaagcttgcagaggctgcagagagaagacaaaaagaggctgcatctcggggaattttagatgttcaatctgtgcaagaaaagagaaagaaaaaggaaaaaatagaaaaacaaattgctacatccgggcccccaccagaaggtggacttaggtggacagtttcataaagcataacatgagtagaagaatctactgccaataactgtttattatctgcaatcaagtgggcttcatcaatttaatttcttctctttgagtaaatgaagattcagactttgtaatattattgcccttaagtgcaatgctaaaaaaacgttgattttcaagcttagagaatggctagacttttcattaaatactgattttcctacatttgctcttctgcagttagtgggtgatttgctatttttcttagtagttaaaaaatggaactaaatagtgaatatacatacactgcatgtaaacattctgcatatacctctaagattaaaattcgcagttgtcttttcatcctttataaaatgatctaactacttatatttgtgctgcatcgcgttacatctgtttttatttcactatgaagatgtttgattaaacttatggacttagtgcctttaaactgatcatcagggagaatcttgaaaaaatcatttgaagggctgatgtgaaggagcactgtaaatttttataacttagtaatgagtattcttaggcagatgtaaaattttttccaatttatttttatttatgtagcttataaaattaacataccctgttttactttatgataaaggattttttgtttgctgaatttaaaattatatattagtgataccatcagagggcagtgatgttctattgtatattaaattcagctctgtaaggatctttgtagtaattgaatgagttaaactaataatctggatgggttataatgagtagtaatatatttgtccatatttcataagtagtgttaatcttgtgtacttattagagaacgatcataagatttatacagatgtgaaactgcgaaggcaagtatgaatgtatgaaaaaaacatgtaggtactgtacttacaaaaggtctacttcagatataaaaatattaggtaattctatacaatgcatagtcataaaccttaacatttttgttcattagaaacatgaattttatagcattttttgtttctcctatataatacactgaaataaaagaatttgtgttagctattaaggctgatagctcttttaaatggcaaggccacatgttgagccctaaattaaaatttgcagatattaagtgctaatagaaattttaagttaaatcgaccaagttcacttgctttacacaaaggaaactgagccactatcttcatctacccctc

SEQ ID NO: 373432 - DNA, 559 bp, Homo sapiens
cgagccagtggagggcggtgggggcggggcaagcgcggaggaccaggaccggctccggaccgcgcagttagcgccgcctggcctgggccggacccggtcagggttctcaagctgtcgtccctatggggctgtgttttccttgtcccggggagtccgcgcctcccacgccggacctggaagagaaaagagcaaagcttgcagaggctgcagagagaagacaaaaagaggctgcatctcggggaattttagatgttcaatctgtgcaagaaaagagaaagaaaaaggaaaaaatagaaaaacaaattgctacatccgggcccccaccagaaggtggacttaggtggacagtttcataaagcataacatgagtagaagaatctactgccaataactgtttattatctgcaatcaagtgggcttcatcaatttaatttcttctctttgagtaaatgaagattcagactttgtaatattattgcccttaagtgcaatgctaaaaaaacgttgattttcaagcttagagaatggctagacttttcattaaatactgattttccta

SEQ ID NO: 373433 - DNA, 623 bp, Homo sapiens
attttaatcacattgggattcagaagagcaacagaaccaaaggttgtttggtgtgttcatacaatccctggatttataggtggattttctataaaggaaaaatgatgtaattagtatcctgttttttcctaaagaaataatactatcataaaaattctgtctatcctttgtaccccaggaaaatggacatgaactttgaattttccctttctccaaatgtttgactttttattttcactgataagcattatgctatgttcttagaagacaaaagcagctcttgccagttttgaataatttctgcatgaatagaccagtaagaggtaagtagccatgactgcctatatgtgttgagacataaggtatatttctttaacatctccaagcaagcatttcaaattctcttaactactaaacatgctctaagctaattcaaatatagtattgtggcttttttcttcaattttctcaaaagctacagacacaaggcatttgtatgtataacagactttgatgaagttttggttccagtaactcaaaacactaagtttcccatttgatatggctttttattgttctagtctccctcttctagttatgcttcatcttgcaaatattgactt

SEQ ID NO: 373434 - DNA, 1713 bp, Homo sapiens
gcgaggacgggtggacgcgtcaggagggtcgttgggtcctgtcagagcgacctaggccgtcgcctccgtgtagatctccacttttgtaacaaaaagttgtcgaaaggcggctgtggcgtctttctaccttccactgactttagctgcgccggatcttcatagggcgccggcgcacgcagagggcgttacgcgtgggacattccgggggatgtggtagatggaattcggcgcgaaaagacattgctttctccgggagctctttagtcgtctaggagatgtgcgttttcaactgtgtctaccatcttttaaaagaaggaagagaaaagagcaaagcttgcagaggctgcagagagaagacaaaaagaggctgcatctcggggaattttagatgttcaatctgtgcaagaaaagagaaagaaaaaggaaaaaatagaaaaacaaattgctacatccgggcccccaccagaaggtggacttaggtggacagtttcataaagcataacatgagtagaagaatctactgccaataactgtttattatctgcaatcaagtgggcttcatcaatttaatttcttctctttgagtaaatgaagattcagactttgtaatattattgcccttaagtgcaatgctaaaaaaacgttgattttcaagcttagagaatggctagacttttcattaaatactgattttcctacatttgctcttctgcagttagtgggtgatttgctatttttcttagtagttaaaaaatggaactaaatagtgaatatacatacactgcatgtaaacattctgcatatacctctaagattaaaattcgcagttgtcttttcatcctttataaaatgatctaactacttatatttgtgctgcatcgcgttacatctgtttttatttcactatgaagatgtttgattaaacttatggacttagtgcctttaaactgatcatcagggagaatcttgaaaaaatcatttgaagggctgatgtgaaggagcactgtaaatttttataacttagtaatgagtattcttaggcagatgtaaaattttttccaatttatttttatttatgtagcttataaaattaacataccctgttttactttatgataaaggattttttgtttgctgaatttaaaattatatattagtgataccatcagagggcagtgatgttctattgtatattaaattcagctctgtaaggatctttgtagtaattgaatgagttaaactaataatctggatgggttataatgagtagtaatatatttgtccatatttcataagtagtgttaatcttgtgtacttattagagaacgatcataagatttatacagatgtgaaactgcgaaggcaagtatgaatgtatgaaaaaaacatgtaggtactgtacttacaaaaggtctacttcagatataaaaatattaggtaattctatacaatgcatagtcataaaccttaacatttttgttcattagaaacatgaattttatagcattttttgtttctcctatataatacactgaaataaaagaatttgtgttagctattaaggctgatagctcttttaaatggcaaggccacatgttgagccctaaattaaaatttgcagatattaagtgctaatagaaattttaagttaaatcgaccaagttcacttgctttacacaaaggaaactgagccactatcttcatctacccctc

SEQ ID NO: 373435 - DNA, 481 bp, Homo sapiens
  misc_feature (71)..(71): n is a, c, g, or t
atacaaattgtcaacatgggacggagatctacatcatccaccaagagtggaaaatttatgaaccccacagnccaagcccgaaaggaagcccggaagaggaagagaaaagagcaaagcttgcagaggctgcagagagaagacaaaaagaggctgcatctcggggaattttagatgttcaatctgtgcaagaaaagagaaagaaaaaggaaaaaatagaaaaacaaattgctacatccgggcccccaccagaaggtggacttaggtggacagtttcataaagcataacatgagtagaagaatctactgccaataactgtttattatctgcaatcaagtgggcttcatcaatttaatttcttctctttgagtaaatgaagattcagactttgtaatattattgcccttaagtgcaatgctaaaaaaacgttgattttcaagcttagagaatggctagacttttcattaaatactgattttccta

SEQ ID NO: 373436 - DNA, 555 bp, Homo sapiens
agcgtagcgccgagcgtgatgatgcgacagagccggtgcaggcctgtctccatgctgtgcgtcccctatggatgctgtagattgtacccttgttcccgtccgaagtgcgtgctgtcgcacgccggacctgcaagagaacatcagcaagagcttgcagaggctgcacgagagatacgatcacatcacagaggctgcatctcggggaattttagatgttcaatctgtgcaagaaaagagaaagaaaaaggaaaaaatagaaaaacaaattgctacatccgggcccccaccagaaggtggacttaggtggacagtttcataaagcataacatgagtagaagaatctactgccaataactgtttattatctgcaatcaagtgggcttcatcaatttaatttcttctctttgagtaaatgaagattcagactttgtaatattattgcccttaagtgcaatgctaaaaaaacgttgattttcaagcttagagaatggctagacttttcattaaatactgattttcctacaaaacaaaaaaaaaaattctccagccgcttga

SEQ ID NO: 373437 - DNA, 813 bp, Homo sapiens
gtaatagagagctcgctctgccacctggaagtatgggctggagacacatttggccaactgccggaagaggggttccatgatcttcacaaattctgatggttcctcgtgccgggacgcgcagttagcgccgcctggcctgggccggacccggtcagggttctcaagctgtcgtccctatggggctgtgttttccttgtcccggggagtccgcgcctcccacgccggacctggaagagaaaagagcaaagcttgcagaggctgcagagagaagacaaaaagaggctgcatctcggggaattttagatgttcaatctgtgcaagaaaagagaaagaaaaaggaaaaaatagaaaaacaaattgctacatccgggcccccaccagaaggtggacttagggaaaatggacatgaactttgaattttccctttctccaaatgtttgactttttattttcactgataagcattatgctatgttcttagaagacaaaagcagctcttgccagttttgaataatttctgcatgaatagaccagtaagagaaaacctttccaacctatgagagaaagagatgtgaagaaagaagacgggtcatagagatgctacattgctgattttgaagatggaggaaggaaatcatggagcttaggaatgcaggtggcctctagaagatggaaaaggaaaggaaatggatgctcccctagactcttcaggaaggaaaacagccttggtgacactctgattttagcctattgaaaccatgttgaatgactgcagaaatgtgagataataaacatgcttattcagctaccaag

SEQ ID NO: 373438 - DNA, 2194 bp, Homo sapiens
gtgacccgcgcggggccgggccgccggcgcagtcgctgcagccgccgcgggaggcgtccgtgacaagatgaagctcatcatcctggagcactattctcaggcgagcgagtgggcggctaaatacatcaggaaccgtatcatccagtttaacccagggccagagaagtacttcaccctggggctccccactggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctcttgttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaaggcctcactgtggctcctctgttttacatactcattagtaagtgggaggtccactggggcaacagacactgccacaatttcagtgttgtgttcagccaaggggacggtctggacaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtattttcaaataacaaatcat

SEQ ID NO: 373439 - DNA, 3252 bp, Homo sapiens
gtgacccgcgcggggccgggccgccggcgcagtcgctgcagccgccgcgggaggcgtccgtgtaagtgggtagcagggctggcggggaccttcctcgcgggccggagcgcggagcgctgccccagccctacggcactcggggtcgggaccccggggagccgccctcacacattttccaggagggatcggaggggcgatggggtggtaatgggggtgggggacacgctgtaccccaccgacgaccgcgcgggccaccttcgcctctttccttcacactcccactaaccgcagtgctgggggaacaaaatgtcctccttctggagcgattaccttttcccttttgtgctttgggggaaactgaagacccagaggggttcgcaaagcaaggtgggccagtaggaagacccctccgctagtccagagagagcacacagctccccaggcagagctcattgccccacctgctctagtggcccagcatgatcccatgacctctctacttctggaggaagagtcttggggtagacggcggggagggggtagggtatcccgttccggtaggggcagggatgagggaggcggggctgagccgagcatctatctggatggtaacagccaacgtagaaaatactaagttgtttacatgcattctctcatttcatattacccgtcgtgaagtctgtgaagtaggtactattgtcccaatttttacataggaggaaacggctcagagagaacttaggtcctttgaccgaggtcctgcaggtggtaagtgaaggagctgagattagaacccagatctgcccccagtggcgcctcctcgtggtctgtgggtggtggagacgactggcctagcctcttagctcctctgtgaatagaaaggcctttttcctggctcagacagcttgggaaggggattgttgctgggtaagagaagcttctcccaccacctccatctctttctctgccccttaccattgattcctttctgtcatcccctctcccccactgcaggacgacaagatgaagctcatcatcctggagcactattctcaggcgagcgagtgggcggctaaatacatcaggaaccgtatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctcttgttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaaggcctcactgtggctcctctgttttacatactcattagtaagtgggaggtccactggggcaacagacactgccacaatttcagtgttgtgttcagccaaggggacggtctggacaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtattttcaaataacaaatcat

SEQ ID NO: 373440 - DNA, 2296 bp, Homo sapiens
gtgacccgcgcggggccgggccgccggcgcagtcgctgcagccgccgcgggaggcgtccgtgacaagatgaagctcatcatcctggagcactattctcaggcgagcgagtgggcggctaaatacatcaggaaccgtatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctcttgttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaaggcctcactgtggctcctctgttttacatactcattagtaagtgggaggtccactggggcaacagacactgccacaatttcagtgttgtgttcagccaaggggacggtctggacaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtattttcaaataacaaatcat

SEQ ID NO: 373441 - DNA, 2348 bp, Homo sapiens
gtgacccgcgcggggccgggccgccggcgcagtcgctgcagccgccgcgggaggcgtccgtgaggaaacggctcagagagaacttaggtcctttgaccgaggtcctgcaggtggacaagatgaagctcatcatcctggagcactattctcaggcgagcgagtgggcggctaaatacatcaggaaccgtatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctcttgttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaaggcctcactgtggctcctctgttttacatactcattagtaagtgggaggtccactggggcaacagacactgccacaatttcagtgttgtgttcagccaaggggacggtctggacaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtattttcaaataacaaatcat

SEQ ID NO: 373442 - DNA, 2194 bp, Homo sapiens
gtgacccgcgcggggccgggccgccggcgcagtcgctgcagccgccgcgggaggcgtccgtgacaagatgaagctcatcatcctggagcactattctcaggcgagcgagtgggcggctaaatacatcaggaaccgtatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctcttgttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaaggcctcactgtggctcctctgttttacatactcattagtaagtgggaggtccactggggcaacagacactgccacaatttcagtgttgtgttcagccaaggggacggtctggacaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtattttcaaataacaaatcat

SEQ ID NO: 373443 - DNA, 389 bp, Homo sapiens
aagagagaagtgtcagctctaagacaaaatttgagagctcctggatgttatgattgataatcaaggaactcttgccactgcctgaattaactactttttgtttttaattttttgtaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagcta

SEQ ID NO: 373444 - DNA, 2712 bp, Homo sapiens
gtgacccgcgcggggccgggccgccggcgcagtcgctgcagccgccgcgggaggcgtccgtgtaagtgggtagcagggctggcggggaccttcctcgcgggccggagcgcggagcgctgccccagccctacggcactcggggtcgggaccccggggagccgccctcacacattttccaggagggatcggaggggcgatggggtggtaatgggggtgggggacacgctgtaccccaccgacgaccgcgcgggccaccttcgcctctttccttcacactcccactaaccgcagtgctgggggaacaaaatgtcctccttctggagcgattaccttttcccttttgtgctttgggggaaactgaagacccagaggggttcgcaaagcaagtctgtgaagtaggtactattgtcccaatttttacataggaggaaacggctcagagagaacttaggtcctttgaccgaggtcctgcaggtggacaagatgaagctcatcatcctggagcactattctcaggcgagcgagtgggcggctaaatacatcaggaaccgtatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctcttgttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaaggcctcactgtggctcctctgttttacatactcattagtaagtgggaggtccactggggcaacagacactgccacaatttcagtgttgtgttcagccaaggggacggtctggacaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtattttcaaataacaaatcat

SEQ ID NO: 373445 - DNA, 2272 bp, Homo sapiens
gtgacccgcgcggggccgggccgccggcgcagtcgctgcagccgccgcgggaggcgtccgtgacaagatgaagctcatcatcctggagcactattctcaggcgagcgagtgggcggctaaatacatcaggaaccgtatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctcttgttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaaggcctcactgtggctcctctgttttacatactcattagtaagtgggaggtccactggggcaacagacactgccacaatttcagtgttgtgttcagccaaggggacggtctggacaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtattttcaaataacaaatcat

SEQ ID NO: 373446 - DNA, 2242 bp, Homo sapiens
gtgacccgcgcggggccgggccgccggcgcagtcgctgcagccgccgcgggaggcgtccgtgacaagatgaagctcatcatcctggagcactattctcaggcgagcgagtgggcggctaaatacatcaggaaccgtatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctcttgttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaaggcctcactgtggctcctctgttttacatactcattagtaagtgggaggtccactggggcaacagacactgccacaatttcagtgttgtgttcagccaaggggacggtctggacaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtattttcaaataacaaatcat

SEQ ID NO: 373447 - DNA, 2231 bp, Homo sapiens
ctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgaggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttcctaatagcagcttggcgtgtatctggtcctagtgaagaggaaggcctgtgtagcagaaaggctttgggcctgagaggttaaggccacagcctgttgacacctgttttggtcctgcgaccctttactggtctccgctggctttgaatcttcctctgggctctactctggagaacataagggctgctgtggttgagtctggctagcactgtctgtggttggcagtgtgtacacccctccgttcagttccttgggggtatttttcagaaatccaaaggcaacccttcgtgcagtgctcacttttttaagtacagttgattacccttgcctgctggggggcctagccatgggccagagatggaggagccccagtggctgacaggccagcctcactcaggcacgtacctgctgaccagtcagccactgccaacccatggcccagccactgtgtgcattagcagggaggtttgtaggccatggaggaaatgaggagacaccacctagtggagacattggggccctgctggggggatggtgtctatagctggctctgctggctccctcaggccctgcttaccaagctctggaggagggagtgctgcattactgagcaccttccttgttctttcctcataggacactgatgttactgtcactttagttatgctaaagtggaggtttcagcctccagaagacagcagagccttctagggtcaccttaagaataggtttagctaggctgggtgtggtggctcatgcctgtaatcccagcactttgggaggctgatgtgggcggatagttgagcccaggagttcgagaccagcctgggcaacatggcaagaccttgtctctacaaaaagtacaaaaattagatgggtgtggtgtttcgcgtctgtagtcccagctatttgggaagctgaggtgggaggatctcgagcctgcgagatcaaggctgcagtgaatcatgatcgtgcgctactgcactccagcctgggccacagagcaagactgtctcaagaaaaaaaattttttaaataagtttaattataaagtgaaggaccagttggaccacggacccctagaaactcagccaaggagacctgactttatctgagacaggaaggcagtggttaaaagaattaaaaaaggacagtggtgcttgacagagcaggactgaagttttcattcctctacctgctggggccttggtcaagtcctaaaagctttccaggtctgtaactggttttgtctgtaaaatggggaaaaggttaccttttctgccacatgaagtagctggctggtgaaatgatgtcatactacgatgtgtttcattaactgttggagattatcacattaaattgagcagatttggatctttta

SEQ ID NO: 373448 - DNA, 992 bp, Homo sapiens
  misc_feature (862)..(862): n is a, c, g, or t
  misc_feature (879)..(879): n is a, c, g, or t
  misc_feature (883)..(883): n is a, c, g, or t
  misc_feature (900)..(901): n is a, c, g, or t
  misc_feature (909)..(909): n is a, c, g, or t
  misc_feature (917)..(917): n is a, c, g, or t
ctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccagattctggggagcaggtcctggtggatgtggagaccaagagcaataaggagatcatggagcacatcagaaaaatcttggggaagaatgaggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttcctaatagcagcttggcgtgtatctggtcctagtgaagaggaaggcctgtgtagcagaaaggctttgggcctgagaggttaaggccacagcctgttgaccggtttggctggacttanggtccgggtgaactccnggcnctggaacaggggggggnngcaccgtngggtgggnaccccaaccggggtcagaccgacctggggctaaaggccccggggccccaaaccggcacattccccccctgtggac

SEQ ID NO: 373449 - DNA, 1723 bp, Homo sapiens
ggagcatgaacgtggctccatggagttcagtagccagaggacaggtctcacttcatgaaacccaaagtttcacaaactgctaataagggctataagccctgtgaaagttggagcccaaatatttggtttgcatctctttaagtaattcttgactttgggctgactttacttaaccaacctgacaggagatgaaatggacctgcagtcagaggcttgaaatgagttaaagcagcaagaatacaggttacgtggacatgatccttaaagaaaaggccacttcaaagtaaggccaagaggatctcagaaaccaaccaagaggtgttcaaagcccaaaacagtccctggaatcagccatcaccagcaaggggacttaaagagcaggaccaggttagaatcagcacctttccaagcaaaatcacgttttctgcaaggttgtttcaccacagcccaacacttccttatccagcctgagtctaagcagcctactggctgccactgaatgacctgggaatgagaggaggggctggtggagaccttttcaccaacaccaagaactgggatctgaaagctgttatgcttgtattcccagggaactgcaacatggccctcatggtcactctcaaggatcaaaacgacggaaggcaggcaacaatctgtgttagaggcaccactgagctgcaggatgcctgctactaaaagccttcacaagcagaaatgaaacaaacctgccctaattccattgtctcagctggttttttgtcttaattttgaaactgaaaacacatcagggttagaaaagtaaaaattactttaagctggcaaaattaaatcctttccatcattttataatggccactcccactactctccaaaatttgctgccaaggcaagaattataaaatgatataattaaatccaaacaagaatttagaagttggaaacactgttcccacttaccctactaacactgacttgcgtaaagtgctgctaacccttcaggatcaagcatcctgttctgccttgagcctgcagcagcttccattctgtccaatgtggcaccacaggggcgtctgtagctggccagactgcacccctgtggagcacatgtggcgccagcctgagccagatcagagcacctgtgagtcaggggagtgtccagggatctttttggatatcatctgattaacaaatcaagagaggcaaatttaacccaacagggtgtattttcttaatctggactatttaaaaagcaaaagacaaagcaattgaccgggtcttccacatgccactgttctcaaacaggaaaagcttgctatatattcacatccgtgggaatttacgggtgtttgaagttagacataacttccttttaagcgcatactgttcttgctgtaaactctggttgctacaatttatgaggagaaagactatcaccctggaaattgagggttgtttttaaggagcaagcagcctgcatttaaaatgctccggggtggtcggctggcacacacctgggggaaccaaagtgcacagtgtgctggtaacattaacagacttgccaacagagatgctgagtctatacacatttttaaaatctctggtatttaaggtcaacaggaagaaattgtcctgaaaccttccatccagctttaccaggccctaaccactctcgccaggcggcagcaggctcctgcccagccccaatccagcctcacagttatga

SEQ ID NO: 373450 - DNA, 684 bp, Homo sapiens
ctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttaggtgagtggggccctcgccatggtccaggggctgtcccagacatgcctggagagactgcgtccttcctatgggagcgtcaggatgagctgcagtgtgcgctgtcatggtgtgtctgtgactcctggcacctttggcttccccataccgaggcactcagcagccactgaggtctggactctttccctctccagcctcacctcttcttaccctctgcctcacaccatgggggtaatttttccaaagtcccttgtcacaccaggctgtgatgcctttgctcaagattgttcctggcctggaatcccatttctacctgcgtttgcttatttaactgaaaaa

SEQ ID NO: 373451 - DNA, 502 bp, Homo sapiens
  misc_feature (2)..(3): n is a, c, g, or t
  misc_feature (10)..(11): n is a, c, g, or t
  misc_feature (14)..(14): n is a, c, g, or t
  misc_feature (37)..(37): n is a, c, g, or t
gnnggggggnnttnaccatatacttattagccgtctnacttgtttgggggatagttacggcaaggagctaaaaatcagtccctcttgagggcaattacacatcttagaagtgactacacctgaaattaaatataaagcccagaacagcaaaagaacctcaaaccacagccttatggcaagggttagacaataaatgtaactcctcaggacacagaaatgtcaaattaggagagtatggtaggtaacacacttccttaaaaacaccttccaggagtaacttgaaaagtattacttgctcaactaatttggtctttcaaaaaatctcttcctgtcctgttttatgctaatgtgtaatgatctccaccattttcaacatctatctgtcttaacccaacattatctgagatacttctggaaaagagctcacttaactgatgacagcatgtgtctgtcccacctctctgagccagctgcctctcctcattgagggaggagcagccag

SEQ ID NO: 373452 - DNA, 7224 bp, Homo sapiens
ctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgaggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttcctaatagcagcttggcgtgtatctggtcctagtgaagaggaaggcctgtgtagcagaaaggctttgggcctgagaggttaaggccacagcctgttgacacctgttttggtcctgcgaccctttactggtctccgctggctttgaatcttcctctgggctctactctggagaacataagggctgctgtggttgagtctggctagcactgtctgtggttggcagtgtgtacacccctccgttcagttccttgggggtatttttcagaaatccaaaggcaacccttcgtgcagtgctcacttttttaagtacagttgattacccttgcctgctggggggcctagccatgggccagagatggaggagccccagtggctgacaggccagcctcactcaggcacgtacctgctgaccagtcagccactgccaacccatggcccagccactgtgtgcattagcagggaggtttgtaggccatggaggaaatgaggagacaccacctagtggagacattggggccctgctggggggatggtgtctatagctggctctgctggctccctcaggccctgcttaccaagctctggaggagggagtgctgcattactgagcaccttccttgttctttcctcataggacactgatgttactgtcactttagttatgctaaagtggaggtttcagcctccagaagacagcagagccttctagggtcaccttaagaataggtttagctaggctgggtgtggtggctcatgcctgtaatcccagcactttgggaggctgatgtgggcggatagttgagcccaggagttcgagaccagcctgggcaacatggcaagaccttgtctctacaaaaagtacaaaaattagatgggtgtggtgtttcgcgtctgtagtcccagctatttgggaagctgaggtgggaggatctcgagcctgcgagatcaaggctgcagtgaatcatgatcgtgcgctactgcactccagcctgggccacagagcaagactgtctcaagaaaaaaaattttttaaataagtttaattataaagtgaaggaccagttggaccacggacccctagaaactcagccaaggagacctgactttatctgagacaggaaggcagtggttaaaagaattaaaaaaggacagtggtgcttgacagagcaggactgaagttttcattcctctacctgctggggccttggtcaagtcctaaaagctttccaggtctgtaactggttttgtctgtaaaatggggaaaaggttaccttttctgccacatgaagtagctggctggtgaaatgatgtcatactacgatgtgtttcattaactgttggagattatcacattaaattgagcagatttggatcttttacatttgatgctcaagtttgattctgtaccagatctgggtttggggtgatggcttgtcgggggtgggaggggaaggtgggcagagactgatgtataatggacaggtgttccttgagtgacagacttacaaagggagtgtttaattgaaatctagcatcttgtctctctgctatcagcattttggctgggtggaaaaagctctcctccacagagagccctcccatgtctgctggtttcagttccccacccaactgactgaagtcttgaccttgataccacctgcctgggcgttctacttggctgcaagggctcttcagaaagcacctagttccttttggctttcatctgcagtgtaggtctccatagctagtgacacacaaagccttatgagagtattccttccctctagggcccaaagaggctgctaaccagcaggaatgtcctgaaccaaaaggagtggtgaccattctctagacagaataaatgtctggtccctaatgggacagataactagggtttgagttcaggcttgacacaggagcaatgggcagtgaggtggacagcccagaccctgaaaggacgtgtggagacagcagcagtcctgtggtgcagttactgcctgtgtggccagcttcacaggcagcagataatttgtggaaataaacattattttctttttttgttccctgtaggctacttgatcctggatagtttctctttaaacctttgtctttccctattttgtttagtagtgatgaaagatgggtttaaaatatacagaaatgggagaaaattaattagagaaaatgtgaggattttataattgataacatgttcttaattttacttgcacaagcagtgttcacagccttattctgaagtgaccacttttcttctctttgaggcactacctggcagcaccatctaaacctgtatcatctgctgtggtcccagttactcaggaggctgaggcaggaggatcacttgagcccaggaggttgaggctggagtgagccatgactgtaccactgcattccagcctgggtgacggagtgaggccctatctgcctgccagtgagttctgtcatgcatcagactttggacctcagaattttcacctggaacatgagaggtcagatgacataatgaatatgttctaacttctgaaacttttggagcttgtttttgcccttgatagcacgtatccttagagaataagcttgccaatttaaggcctgtctgtaatggcatctgaatgttccagcagcctaactgtgctctgctccagaaacatgtgtgtggcttccctacctccacaccaaggagctgccttgctgggtggatgtaaagactgtcctgccagggtttcccactaaaggtattaataagtccagtggaccacagagggcccaatccctcttggccgctaaggctaaggtaggagccagagagctgtagagacaggaccaccaggatgcttcatgtccataacacaagagagcgctgcattgtttgggggccaggcattactactatcatgaagaaaaatgaagagcaggatgcatgttagtctttaattcacttttaatagtataaacctcatttaggtagtagtattaagccacaacaataatgccacattgaaacagcatttaataaaatgcataaagctaattcatgcactgcaatactctatatacaaacacaacaatgcaaattcttcttcaagactgaagacattgattagatataaaattcagtttaaaaagaacatgctattttttaaatgccatcacataaacaaagtgatttcacagggagaagaaagctgtataaagctgcagctttcaacaggttttaaacctggcattaaaatgtaatggcaaaaccaatattttctatattgtgaagggcaaaggttacagaaacggtcccaagaaaatctaacacccaaattttcctttgatagatagatgcctttaaaagggctggtaatgcagttacattctaacagagaagtccaaactacaggtaaaaactacggcttgtactgtgaaaaatgtgcagcttttcagttataaaactagttgaacactggtttacaagataatccgtagaacagagagactgtagaaaaatattccagcacttgagttgtgtgtggcagcagcatttgagtccatgaatgctatggtcattaaaataattgattatactttcctaaagaaaagccattttttaatgcaaagtctactacttccaaatgttattccaaacattaaattttaacagtctatcaatcaataaatgttgaacattttttttctattttgcatgtataaatatcaagacaccaaaattatttatagctgggcattaaaaatatctgacatttttctccccgcaaagatacttttcttaagctcacactttaattatttgtagactgctgttaagctaaatagccccaaaggaaacttttaattcatttagagactgtcaagtttccaattgcattttaactagaaagccactttcaatagcgtgattgtcacgacaggctatgacggggaaaggtcgcacaatcttgtgggatgaggccagtgaaatagaagctttctctacatcaaaaacagggaagctgaaggctaaatgacccactgtctcacaaaaggcactgagtactatggtctcataaagtgtttttaaaacattttgataacttattttaaaaagaaaaagaggaaactgtggattatgtgagtttttgcagcaatctagtgattccttccagcaggcccctgcttcccaggtctatgagcaactactgctgggccaggccctggctctcaagggccgagtctcagtttaaggccagattaagggggaaaattcgtccgagtagacctggacgaggaaaatttggtatctgtagcttttaagggcacacatatccatattaaaatgcaattcttatctgaaaatttaaaatcataacttatagaaaggagttaaagtcatttacatgcttacagttagagaagtaacttgagatctgtagcttatatgccgcagaagttagccatcaacatccatgcttagttttaaagaataatacttggtaggttgtttatttttaactggcgatagaaagatgggaattactatttattcagtcataggacagtgccccacatcttgctgactgagcacagcgcaagcctgggaaattgctaccatctttgggagtcaggcctcactgacacagaccgttctgaatctctgaccgtgacgcctgtctctgggctactcaacagagctgaatagctgggaaggctgatggctcaacccaactgccaagttccttccaggtagggccatgaataggtgcatgaaaaggttaaaaattcccacttagttttggatattaagataaactgtcttccagcttcctggctcttgtccgaacctagagaatatacggaaatgtcaccctgtcagaacctcttctgcctggaattcttccttttgcagagtggagattctgacttcatggcccttcccaggcaggctcacccaaaggaaaatggagtgaagaaaatcaccagcaaatcttccctgccgagggaccttggaacacccatatcagtttacattagcaactttatgaaaaactctctttaaaggaaagtttggatacatgtctgtatacataatatacatctatgtacacatacacacactatatacactgtacatatggagaggatataaacacatgtacattcattcagtcttacagcctagaaacctgtacacgcacaatgctgctgaagggacccagggctggacatacgaagtgcacgctggtgggaggcacacaatgagaaggtccagaccctgtgtacaaaagacccaaaccaaccctgtcttgatgaggggttggctttaaaaatttacatcaaagttaagacattttcaaagagcctcataactgagagaatggaagctggataaaggaagcacgtggggcatctgctctgctggctcaggcattcccagggcccagtgggcaccgccttccctgggagaaaagtggctgtcagatgatgagacttcctatgacctggactaagaaaagagttaaaatgttacctatgaccccattgcacataaagtcatttacactggaaagtgggcaacaagcttctggactccaatgagatcaggtcccagaacatggatgtacacatgtggcatgaactgctgattgcggccaggggctggaagccctgcagagggcgggctgtgagcaagagtgctctgcaggaaatgtcctcaaaggactatgaaagtaaaagcactagaaacagctagagtccttagaattttttgctccttgccgtaactatcccccaaacaagtaagacagctaataagtatgtgtgtagcgtggatattgccttgagattaaggagcctaacgcatccactgttaacaccatggctggtgtcctaactgcctcagaagagtccacattcaatactgacaatgacaagctaaaaatcagtccctcttgagggcaattacacatcttagaagtgactacacctgaaattaaatataaagcccagaacagcaaaagaacctcaaaccacagccttatggcaagggttagacaataaatgtaactcctcaggacacagaaatgtcaaattaggagagtatggtaggtaacacacttccttaaaaacaccttccaggagtaacttgaaaagtattacttgctcaactaatttggtctttcaaaaaatctcttcctgtcctgttttatgctaatgtgtaatgatctccaccattttcaacatctatctgtcttaacccaacattatctgagatacttctggaaaagagctcacttaactgatgacagcatgtgtctgtcccacctctctgagccagctgcctctcctcattgagggaggagcagccag

SEQ ID NO: 373453 - DNA, 7028 bp, Homo sapiens
ctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgaggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttcctaatagcagcttggcgtgtatctggtcctagtgaagaggaaggcctgtgtagcagaaaggctttgggcctgagaggttaaggccacagcctgttgacacctgttttggtcctgcgaccctttactggtctccgctggctttgaatcttcctctgggctctactctggagaacataagggctgctgtggttgagtctggctagcactgtctgtggttggcagtgtgtacacccctccgttcagttccttgggggtatttttcagaaatccaaaggcaacccttcgtgcagtgctcacttttttaagtacagttgattacccttgcctgctggggggcctagccatgggccagagatggaggagccccagtggctgacaggccagcctcactcaggcacgtacctgctgaccagtcagccactgccaacccatggcccagccactgtgtgcattagcagggaggtttgtaggccatggaggaaatgaggagacaccacctagtggagacattggggccctgctggggggatggtgtctatagctggctctgctggctccctcaggccctgcttaccaagctctggaggagggagtgctgcattactgagcaccttccttgttctttcctcataggacagctgatgtgggcggatagttgagcccaggagttcgagaccagcctgggcaacatggcaagaccttgtctctacaaaaagtactgaggtgggaggatctcgagcctgcgagatcaaggctgcagtgaatcatgatcgtgcgctactgcactccagcctgggccacagagcaagactgtctcaagaaaaaaaattttttaaataagtttaattataaagtgaaggaccagttggaccacggacccctagaaactcagccaaggagacctgactttatctgagacaggaaggcagtggttaaaagaattaaaaaaggacagtggtgcttgacagagcaggactgaagttttcattcctctacctgctggggccttggtcaagtcctaaaagctttccaggtctgtaactggttttgtctgtaaaatggggaaaaggttaccttttctgccacatgaagtagctggctggtgaaatgatgtcatactacgatgtgtttcattaactgttggagattatcacattaaattgagcagatttggatcttttacatttgatgctcaagtttgattctgtaccagatctgggtttggggtgatggcttgtcgggggtgggaggggaaggtgggcagagactgatgtataatggacaggtgttccttgagtgacagacttacaaagggagtgtttaattgaaatctagcatcttgtctctctgctatcagcattttggctgggtggaaaaagctctcctccacagagagccctcccatgtctgctggtttcagttccccacccaactgactgaagtcttgaccttgataccacctgcctgggcgttctacttggctgcaagggctcttcagaaagcacctagttccttttggctttcatctgcagtgtaggtctccatagctagtgacacacaaagccttatgagagtattccttccctctagggcccaaagaggctgctaaccagcaggaatgtcctgaaccaaaaggagtggtgaccattctctagacagaataaatgtctggtccctaatgggacagataactagggtttgagttcaggcttgacacaggagcaatgggcagtgaggtggacagcccagaccctgaaaggacgtgtggagacagcagcagtcctgtggtgcagttactgcctgtgtggccagcttcacaggcagcagataatttgtggaaataaacattattttctttttttgttccctgtaggctacttgatcctggatagtttctctttaaacctttgtctttccctattttgtttagtagtgatgaaagatgggtttaaaatatacagaaatgggagaaaattaattagagaaaatgtgaggattttataattgataacatgttcttaattttacttgcacaagcagtgttcacagccttattctgaagtgaccacttttcttctctttgaggcactacctggcagcaccatctaaacctgtatcatctgctgtggtcccagttactcaggaggctgaggcaggaggatcacttgagcccaggaggttgaggctggagtgagccatgactgtaccactgcattccagcctgggtgacggagtgaggccctatctgcctgccagtgagttctgtcatgcatcagactttggacctcagaattttcacctggaacatgagaggtcagatgacataatgaatatgttctaacttctgaaacttttggagcttgtttttgcccttgatagcacgtatccttagagaataagcttgccaatttaaggcctgtctgtaatggcatctgaatgttccagcagcctaactgtgctctgctccagaaacatgtgtgtggcttccctacctccacaccaaggagctgccttgctgggtggatgtaaagactgtcctgccagggtttcccactaaaggtattaataagtccagtggaccacagagggcccaatccctcttggccgctaaggctaaggtaggagccagagagctgtagagacaggaccaccaggatgcttcatgtccataacacaagagagcgctgcattgtttgggggccaggcattactactatcatgaagaaaaatgaagagcaggatgcatgttagtctttaattcacttttaatagtataaacctcatttaggtagtagtattaagccacaacaataatgccacattgaaacagcatttaataaaatgcataaagctaattcatgcactgcaatactctatatacaaacacaacaatgcaaattcttcttcaagactgaagacattgattagatataaaattcagtttaaaaagaacatgctattttttaaatgccatcacataaacaaagtgatttcacagggagaagaaagctgtataaagctgcagctttcaacaggttttaaacctggcattaaaatgtaatggcaaaaccaatattttctatattgtgaagggcaaaggttacagaaacggtcccaagaaaatctaacacccaaattttcctttgatagatagatgcctttaaaagggctggtaatgcagttacattctaacagagaagtccaaactacaggtaaaaactacggcttgtactgtgaaaaatgtgcagcttttcagttataaaactagttgaacactggtttacaagataatccgtagaacagagagactgtagaaaaatattccagcacttgagttgtgtgtggcagcagcatttgagtccatgaatgctatggtcattaaaataattgattatactttcctaaagaaaagccattttttaatgcaaagtctactacttccaaatgttattccaaacattaaattttaacagtctatcaatcaataaatgttgaacattttttttctattttgcatgtataaatatcaagacaccaaaattatttatagctgggcattaaaaatatctgacatttttctccccgcaaagatacttttcttaagctcacactttaattatttgtagactgctgttaagctaaatagccccaaaggaaacttttaattcatttagagactgtcaagtttccaattgcattttaactagaaagccactttcaatagcgtgattgtcacgacaggctatgacggggaaaggtcgcacaatcttgtgggatgaggccagtgaaatagaagctttctctacatcaaaaacagggaagctgaaggctaaatgacccactgtctcacaaaaggcactgagtactatggtctcataaagtgtttttaaaacattttgataacttattttaaaaagaaaaagaggaaactgtggattatgtgagtttttgcagcaatctagtgattccttccagcaggcccctgcttcccaggtctatgagcaactactgctgggccaggccctggctctcaagggccgagtctcagtttaaggccagattaagggggaaaattcgtccgagtagacctggacgaggaaaatttggtatctgtagcttttaagggcacacatatccatattaaaatgcaattcttatctgaaaatttaaaatcataacttatagaaaggagttaaagtcatttacatgcttacagttagagaagtaacttgagatctgtagcttatatgccgcagaagttagccatcaacatccatgcttagttttaaagaataatacttggtaggttgtttatttttaactggcgatagaaagatgggaattactatttattcagtcataggacagtgccccacatcttgctgactgagcacagcgcaagcctgggaaattgctaccatctttgggagtcaggcctcactgacacagaccgttctgaatctctgaccgtgacgcctgtctctgggctactcaacagagctgaatagctgggaaggctgatggctcaacccaactgccaagttccttccaggtagggccatgaataggtgcatgaaaaggttaaaaattcccacttagttttggatattaagataaactgtcttccagcttcctggctcttgtccgaacctagagaatatacggaaatgtcaccctgtcagaacctcttctgcctggaattcttccttttgcagagtggagattctgacttcatggcccttcccaggcaggctcacccaaaggaaaatggagtgaagaaaatcaccagcaaatcttccctgccgagggaccttggaacacccatatcagtttacattagcaactttatgaaaaactctctttaaaggaaagtttggatacatgtctgtatacataatatacatctatgtacacatacacacactatatacactgtacatatggagaggatataaacacatgtacattcattcagtcttacagcctagaaacctgtacacgcacaatgctgctgaagggacccagggctggacatacgaagtgcacgctggtgggaggcacacaatgagaaggtccagaccctgtgtacaaaagacccaaaccaaccctgtcttgatgaggggttggctttaaaaatttacatcaaagttaagacattttcaaagagcctcataactgagagaatggaagctggataaaggaagcacgtggggcatctgctctgctggctcaggcattcccagggcccagtgggcaccgccttccctgggagaaaagtggctgtcagatgatgagacttcctatgacctggactaagaaaagagttaaaatgttacctatgaccccattgcacataaagtcatttacactggaaagtgggcaacaagcttctggactccaatgagatcaggtcccagaacatggatgtacacatgtggcatgaactgctgattgcggccaggggctggaagccctgcagagggcgggctgtgagcaagagtgctctgcaggaaatgtcctcaaaggactatgaaagtaaaagcactagaaacagctagagtccttagaattttttgctccttgccgtaactatcccccaaacaagtaagacagctaataagtatgtgtgtagcgtggatattgccttgagattaaggagcctaacgcatccactgttaacaccatggctggtgtcctaactgcctcagaagagtccacattcaatactgacaatgacaagctaaaaatcagtccctcttgagggcaattacacatcttagaagtgactacacctgaaattaaatataaagcccagaacagcaaaagaacctcaaaccacagccttatggcaagggttagacaataaatgtaactcctcaggacacagaaatgtcaaattaggagagtatggtaggtaacacacttccttaaaaacaccttccaggagtaacttgaaaagtattacttgctcaactaatttggtctttcaaaaaatctcttcctgtcctgttttatgctaatgtgtaatgatctccaccattttcaacatctatctgtcttaacccaacattatctgagatacttctggaaaagagctcacttaactgatgacagcatgtgtctgtcccacctctctgagccagctgcctctcctcattgagggaggagcagccag

SEQ ID NO: 373454 - DNA, 7313 bp, Homo sapiens
ctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgagtgagttgtttggtttgacctggaaggaacaaacttctcagcccagagaatttgaggaagaaaggggtgtgtgggaagggtgttgagagggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttcctaatagcagcttggcgtgtatctggtcctagtgaagaggaaggcctgtgtagcagaaaggctttgggcctgagaggttaaggccacagcctgttgacacctgttttggtcctgcgaccctttactggtctccgctggctttgaatcttcctctgggctctactctggagaacataagggctgctgtggttgagtctggctagcactgtctgtggttggcagtgtgtacacccctccgttcagttccttgggggtatttttcagaaatccaaaggcaacccttcgtgcagtgctcacttttttaagtacagttgattacccttgcctgctggggggcctagccatgggccagagatggaggagccccagtggctgacaggccagcctcactcaggcacgtacctgctgaccagtcagccactgccaacccatggcccagccactgtgtgcattagcagggaggtttgtaggccatggaggaaatgaggagacaccacctagtggagacattggggccctgctggggggatggtgtctatagctggctctgctggctccctcaggccctgcttaccaagctctggaggagggagtgctgcattactgagcaccttccttgttctttcctcataggacactgatgttactgtcactttagttatgctaaagtggaggtttcagcctccagaagacagcagagccttctagggtcaccttaagaataggtttagctaggctgggtgtggtggctcatgcctgtaatcccagcactttgggaggctgatgtgggcggatagttgagcccaggagttcgagaccagcctgggcaacatggcaagaccttgtctctacaaaaagtacaaaaattagatgggtgtggtgtttcgcgtctgtagtcccagctatttgggaagctgaggtgggaggatctcgagcctgcgagatcaaggctgcagtgaatcatgatcgtgcgctactgcactccagcctgggccacagagcaagactgtctcaagaaaaaaaattttttaaataagtttaattataaagtgaaggaccagttggaccacggacccctagaaactcagccaaggagacctgactttatctgagacaggaaggcagtggttaaaagaattaaaaaaggacagtggtgcttgacagagcaggactgaagttttcattcctctacctgctggggccttggtcaagtcctaaaagctttccaggtctgtaactggttttgtctgtaaaatggggaaaaggttaccttttctgccacatgaagtagctggctggtgaaatgatgtcatactacgatgtgtttcattaactgttggagattatcacattaaattgagcagatttggatcttttacatttgatgctcaagtttgattctgtaccagatctgggtttggggtgatggcttgtcgggggtgggaggggaaggtgggcagagactgatgtataatggacaggtgttccttgagtgacagacttacaaagggagtgtttaattgaaatctagcatcttgtctctctgctatcagcattttggctgggtggaaaaagctctcctccacagagagccctcccatgtctgctggtttcagttccccacccaactgactgaagtcttgaccttgataccacctgcctgggcgttctacttggctgcaagggctcttcagaaagcacctagttccttttggctttcatctgcagtgtaggtctccatagctagtgacacacaaagccttatgagagtattccttccctctagggcccaaagaggctgctaaccagcaggaatgtcctgaaccaaaaggagtggtgaccattctctagacagaataaatgtctggtccctaatgggacagataactagggtttgagttcaggcttgacacaggagcaatgggcagtgaggtggacagcccagaccctgaaaggacgtgtggagacagcagcagtcctgtggtgcagttactgcctgtgtggccagcttcacaggcagcagataatttgtggaaataaacattattttctttttttgttccctgtaggctacttgatcctggatagtttctctttaaacctttgtctttccctattttgtttagtagtgatgaaagatgggtttaaaatatacagaaatgggagaaaattaattagagaaaatgtgaggattttataattgataacatgttcttaattttacttgcacaagcagtgttcacagccttattctgaagtgaccacttttcttctctttgaggcactacctggcagcaccatctaaacctgtatcatctgctgtggtcccagttactcaggaggctgaggcaggaggatcacttgagcccaggaggttgaggctggagtgagccatgactgtaccactgcattccagcctgggtgacggagtgaggccctatctgcctgccagtgagttctgtcatgcatcagactttggacctcagaattttcacctggaacatgagaggtcagatgacataatgaatatgttctaacttctgaaacttttggagcttgtttttgcccttgatagcacgtatccttagagaataagcttgccaatttaaggcctgtctgtaatggcatctgaatgttccagcagcctaactgtgctctgctccagaaacatgtgtgtggcttccctacctccacaccaaggagctgccttgctgggtggatgtaaagactgtcctgccagggtttcccactaaaggtattaataagtccagtggaccacagagggcccaatccctcttggccgctaaggctaaggtaggagccagagagctgtagagacaggaccaccaggatgcttcatgtccataacacaagagagcgctgcattgtttgggggccaggcattactactatcatgaagaaaaatgaagagcaggatgcatgttagtctttaattcacttttaatagtataaacctcatttaggtagtagtattaagccacaacaataatgccacattgaaacagcatttaataaaatgcataaagctaattcatgcactgcaatactctatatacaaacacaacaatgcaaattcttcttcaagactgaagacattgattagatataaaattcagtttaaaaagaacatgctattttttaaatgccatcacataaacaaagtgatttcacagggagaagaaagctgtataaagctgcagctttcaacaggttttaaacctggcattaaaatgtaatggcaaaaccaatattttctatattgtgaagggcaaaggttacagaaacggtcccaagaaaatctaacacccaaattttcctttgatagatagatgcctttaaaagggctggtaatgcagttacattctaacagagaagtccaaactacaggtaaaaactacggcttgtactgtgaaaaatgtgcagcttttcagttataaaactagttgaacactggtttacaagataatccgtagaacagagagactgtagaaaaatattccagcacttgagttgtgtgtggcagcagcatttgagtccatgaatgctatggtcattaaaataattgattatactttcctaaagaaaagccattttttaatgcaaagtctactacttccaaatgttattccaaacattaaattttaacagtctatcaatcaataaatgttgaacattttttttctattttgcatgtataaatatcaagacaccaaaattatttatagctgggcattaaaaatatctgacatttttctccccgcaaagatacttttcttaagctcacactttaattatttgtagactgctgttaagctaaatagccccaaaggaaacttttaattcatttagagactgtcaagtttccaattgcattttaactagaaagccactttcaatagcgtgattgtcacgacaggctatgacggggaaaggtcgcacaatcttgtgggatgaggccagtgaaatagaagctttctctacatcaaaaacagggaagctgaaggctaaatgacccactgtctcacaaaaggcactgagtactatggtctcataaagtgtttttaaaacattttgataacttattttaaaaagaaaaagaggaaactgtggattatgtgagtttttgcagcaatctagtgattccttccagcaggcccctgcttcccaggtctatgagcaactactgctgggccaggccctggctctcaagggccgagtctcagtttaaggccagattaagggggaaaattcgtccgagtagacctggacgaggaaaatttggtatctgtagcttttaagggcacacatatccatattaaaatgcaattcttatctgaaaatttaaaatcataacttatagaaaggagttaaagtcatttacatgcttacagttagagaagtaacttgagatctgtagcttatatgccgcagaagttagccatcaacatccatgcttagttttaaagaataatacttggtaggttgtttatttttaactggcgatagaaagatgggaattactatttattcagtcataggacagtgccccacatcttgctgactgagcacagcgcaagcctgggaaattgctaccatctttgggagtcaggcctcactgacacagaccgttctgaatctctgaccgtgacgcctgtctctgggctactcaacagagctgaatagctgggaaggctgatggctcaacccaactgccaagttccttccaggtagggccatgaataggtgcatgaaaaggttaaaaattcccacttagttttggatattaagataaactgtcttccagcttcctggctcttgtccgaacctagagaatatacggaaatgtcaccctgtcagaacctcttctgcctggaattcttccttttgcagagtggagattctgacttcatggcccttcccaggcaggctcacccaaaggaaaatggagtgaagaaaatcaccagcaaatcttccctgccgagggaccttggaacacccatatcagtttacattagcaactttatgaaaaactctctttaaaggaaagtttggatacatgtctgtatacataatatacatctatgtacacatacacacactatatacactgtacatatggagaggatataaacacatgtacattcattcagtcttacagcctagaaacctgtacacgcacaatgctgctgaagggacccagggctggacatacgaagtgcacgctggtgggaggcacacaatgagaaggtccagaccctgtgtacaaaagacccaaaccaaccctgtcttgatgaggggttggctttaaaaatttacatcaaagttaagacattttcaaagagcctcataactgagagaatggaagctggataaaggaagcacgtggggcatctgctctgctggctcaggcattcccagggcccagtgggcaccgccttccctgggagaaaagtggctgtcagatgatgagacttcctatgacctggactaagaaaagagttaaaatgttacctatgaccccattgcacataaagtcatttacactggaaagtgggcaacaagcttctggactccaatgagatcaggtcccagaacatggatgtacacatgtggcatgaactgctgattgcggccaggggctggaagccctgcagagggcgggctgtgagcaagagtgctctgcaggaaatgtcctcaaaggactatgaaagtaaaagcactagaaacagctagagtccttagaattttttgctccttgccgtaactatcccccaaacaagtaagacagctaataagtatgtgtgtagcgtggatattgccttgagattaaggagcctaacgcatccactgttaacaccatggctggtgtcctaactgcctcagaagagtccacattcaatactgacaatgacaagctaaaaatcagtccctcttgagggcaattacacatcttagaagtgactacacctgaaattaaatataaagcccagaacagcaaaagaacctcaaaccacagccttatggcaagggttagacaataaatgtaactcctcaggacacagaaatgtcaaattaggagagtatggtaggtaacacacttccttaaaaacaccttccaggagtaacttgaaaagtattacttgctcaactaatttggtctttcaaaaaatctcttcctgtcctgttttatgctaatgtgtaatgatctccaccattttcaacatctatctgtcttaacccaacattatctgagatacttctggaaaagagctcacttaactgatgacagcatgtgtctgtcccacctctctgagccagctgcctctcctcattgagggaggagcagccag

SEQ ID NO: 373455 - DNA, 7029 bp, Homo sapiens
ctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccagggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttcctaatagcagcttggcgtgtatctggtcctagtgaagaggaaggcctgtgtagcagaaaggctttgggcctgagaggttaaggccacagcctgttgacacctgttttggtcctgcgaccctttactggtctccgctggctttgaatcttcctctgggctctactctggagaacataagggctgctgtggttgagtctggctagcactgtctgtggttggcagtgtgtacacccctccgttcagttccttgggggtatttttcagaaatccaaaggcaacccttcgtgcagtgctcacttttttaagtacagttgattacccttgcctgctggggggcctagccatgggccagagatggaggagccccagtggctgacaggccagcctcactcaggcacgtacctgctgaccagtcagccactgccaacccatggcccagccactgtgtgcattagcagggaggtttgtaggccatggaggaaatgaggagacaccacctagtggagacattggggccctgctggggggatggtgtctatagctggctctgctggctccctcaggccctgcttaccaagctctggaggagggagtgctgcattactgagcaccttccttgttctttcctcataggacactgatgttactgtcactttagttatgctaaagtggaggtttcagcctccagaagacagcagagccttctagggtcaccttaagaataggtttagctaggctgggtgtggtggctcatgcctgtaatcccagcactttgggaggctgatgtgggcggatagttgagcccaggagttcgagaccagcctgggcaacatggcaagaccttgtctctacaaaaagtacaaaaattagatgggtgtggtgtttcgcgtctgtagtcccagctatttgggaagctgaggtgggaggatctcgagcctgcgagatcaaggctgcagtgaatcatgatcgtgcgctactgcactccagcctgggccacagagcaagactgtctcaagaaaaaaaattttttaaataagtttaattataaagtgaaggaccagttggaccacggacccctagaaactcagccaaggagacctgactttatctgagacaggaaggcagtggttaaaagaattaaaaaaggacagtggtgcttgacagagcaggactgaagttttcattcctctacctgctggggccttggtcaagtcctaaaagctttccaggtctgtaactggttttgtctgtaaaatggggaaaaggttaccttttctgccacatgaagtagctggctggtgaaatgatgtcatactacgatgtgtttcattaactgttggagattatcacattaaattgagcagatttggatcttttacatttgatgctcaagtttgattctgtaccagatctgggtttggggtgatggcttgtcgggggtgggaggggaaggtgggcagagactgatgtataatggacaggtgttccttgagtgacagacttacaaagggagtgtttaattgaaatctagcatcttgtctctctgctatcagcattttggctgggtggaaaaagctctcctccacagagagccctcccatgtctgctggtttcagttccccacccaactgactgaagtcttgaccttgataccacctgcctgggcgttctacttggctgcaagggctcttcagaaagcacctagttccttttggctttcatctgcagtgtaggtctccatagctagtgacacacaaagccttatgagagtattccttccctctagggcccaaagaggctgctaaccagcaggaatgtcctgaaccaaaaggagtggtgaccattctctagacagaataaatgtctggtccctaatgggacagataactagggtttgagttcaggcttgacacaggagcaatgggcagtgaggtggacagcccagaccctgaaaggacgtgtggagacagcagcagtcctgtggtgcagttactgcctgtgtggccagcttcacaggcagcagataatttgtggaaataaacattattttctttttttgttccctgtaggctacttgatcctggatagtttctctttaaacctttgtctttccctattttgtttagtagtgatgaaagatgggtttaaaatatacagaaatgggagaaaattaattagagaaaatgtgaggattttataattgataacatgttcttaattttacttgcacaagcagtgttcacagccttattctgaagtgaccacttttcttctctttgaggcactacctggcagcaccatctaaacctgtatcatctgctgtggtcccagttactcaggaggctgaggcaggaggatcacttgagcccaggaggttgaggctggagtgagccatgactgtaccactgcattccagcctgggtgacggagtgaggccctatctgcctgccagtgagttctgtcatgcatcagactttggacctcagaattttcacctggaacatgagaggtcagatgacataatgaatatgttctaacttctgaaacttttggagcttgtttttgcccttgatagcacgtatccttagagaataagcttgccaatttaaggcctgtctgtaatggcatctgaatgttccagcagcctaactgtgctctgctccagaaacatgtgtgtggcttccctacctccacaccaaggagctgccttgctgggtggatgtaaagactgtcctgccagggtttcccactaaaggtattaataagtccagtggaccacagagggcccaatccctcttggccgctaaggctaaggtaggagccagagagctgtagagacaggaccaccaggatgcttcatgtccataacacaagagagcgctgcattgtttgggggccaggcattactactatcatgaagaaaaatgaagagcaggatgcatgttagtctttaattcacttttaatagtataaacctcatttaggtagtagtattaagccacaacaataatgccacattgaaacagcatttaataaaatgcataaagctaattcatgcactgcaatactctatatacaaacacaacaatgcaaattcttcttcaagactgaagacattgattagatataaaattcagtttaaaaagaacatgctattttttaaatgccatcacataaacaaagtgatttcacagggagaagaaagctgtataaagctgcagctttcaacaggttttaaacctggcattaaaatgtaatggcaaaaccaatattttctatattgtgaagggcaaaggttacagaaacggtcccaagaaaatctaacacccaaattttcctttgatagatagatgcctttaaaagggctggtaatgcagttacattctaacagagaagtccaaactacaggtaaaaactacggcttgtactgtgaaaaatgtgcagcttttcagttataaaactagttgaacactggtttacaagataatccgtagaacagagagactgtagaaaaatattccagcacttgagttgtgtgtggcagcagcatttgagtccatgaatgctatggtcattaaaataattgattatactttcctaaagaaaagccattttttaatgcaaagtctactacttccaaatgttattccaaacattaaattttaacagtctatcaatcaataaatgttgaacattttttttctattttgcatgtataaatatcaagacaccaaaattatttatagctgggcattaaaaatatctgacatttttctccccgcaaagatacttttcttaagctcacactttaattatttgtagactgctgttaagctaaatagccccaaaggaaacttttaattcatttagagactgtcaagtttccaattgcattttaactagaaagccactttcaatagcgtgattgtcacgacaggctatgacggggaaaggtcgcacaatcttgtgggatgaggccagtgaaatagaagctttctctacatcaaaaacagggaagctgaaggctaaatgacccactgtctcacaaaaggcactgagtactatggtctcataaagtgtttttaaaacattttgataacttattttaaaaagaaaaagaggaaactgtggattatgtgagtttttgcagcaatctagtgattccttccagcaggcccctgcttcccaggtctatgagcaactactgctgggccaggccctggctctcaagggccgagtctcagtttaaggccagattaagggggaaaattcgtccgagtagacctggacgaggaaaatttggtatctgtagcttttaagggcacacatatccatattaaaatgcaattcttatctgaaaatttaaaatcataacttatagaaaggagttaaagtcatttacatgcttacagttagagaagtaacttgagatctgtagcttatatgccgcagaagttagccatcaacatccatgcttagttttaaagaataatacttggtaggttgtttatttttaactggcgatagaaagatgggaattactatttattcagtcataggacagtgccccacatcttgctgactgagcacagcgcaagcctgggaaattgctaccatctttgggagtcaggcctcactgacacagaccgttctgaatctctgaccgtgacgcctgtctctgggctactcaacagagctgaatagctgggaaggctgatggctcaacccaactgccaagttccttccaggtagggccatgaataggtgcatgaaaaggttaaaaattcccacttagttttggatattaagataaactgtcttccagcttcctggctcttgtccgaacctagagaatatacggaaatgtcaccctgtcagaacctcttctgcctggaattcttccttttgcagagtggagattctgacttcatggcccttcccaggcaggctcacccaaaggaaaatggagtgaagaaaatcaccagcaaatcttccctgccgagggaccttggaacacccatatcagtttacattagcaactttatgaaaaactctctttaaaggaaagtttggatacatgtctgtatacataatatacatctatgtacacatacacacactatatacactgtacatatggagaggatataaacacatgtacattcattcagtcttacagcctagaaacctgtacacgcacaatgctgctgaagggacccagggctggacatacgaagtgcacgctggtgggaggcacacaatgagaaggtccagaccctgtgtacaaaagacccaaaccaaccctgtcttgatgaggggttggctttaaaaatttacatcaaagttaagacattttcaaagagcctcataactgagagaatggaagctggataaaggaagcacgtggggcatctgctctgctggctcaggcattcccagggcccagtgggcaccgccttccctgggagaaaagtggctgtcagatgatgagacttcctatgacctggactaagaaaagagttaaaatgttacctatgaccccattgcacataaagtcatttacactggaaagtgggcaacaagcttctggactccaatgagatcaggtcccagaacatggatgtacacatgtggcatgaactgctgattgcggccaggggctggaagccctgcagagggcgggctgtgagcaagagtgctctgcaggaaatgtcctcaaaggactatgaaagtaaaagcactagaaacagctagagtccttagaattttttgctccttgccgtaactatcccccaaacaagtaagacagctaataagtatgtgtgtagcgtggatattgccttgagattaaggagcctaacgcatccactgttaacaccatggctggtgtcctaactgcctcagaagagtccacattcaatactgacaatgacaagctaaaaatcagtccctcttgagggcaattacacatcttagaagtgactacacctgaaattaaatataaagcccagaacagcaaaagaacctcaaaccacagccttatggcaagggttagacaataaatgtaactcctcaggacacagaaatgtcaaattaggagagtatggtaggtaacacacttccttaaaaacaccttccaggagtaacttgaaaagtattacttgctcaactaatttggtctttcaaaaaatctcttcctgtcctgttttatgctaatgtgtaatgatctccaccattttcaacatctatctgtcttaacccaacattatctgagatacttctggaaaagagctcacttaactgatgacagcatgtgtctgtcccacctctctgagccagctgcctctcctcattgagggaggagcagccag

SEQ ID NO: 373456 - DNA, 4526 bp, Homo sapiens
ctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgagcactacctggcagcaccatctaaacctgtatcatctgctgtggtcccagttactcaggaggctgaggcaggaggatcacttgagcccaggaggttgaggctggagtgagccatgactgtaccactgcattccagcctgggtgacggagtgaggccctatctgcctgccagtgagttctgtcatgcatcagactttggacctcagaattttcacctggaacatgagaggtcagatgacataatgaatatgttctaacttctgaaacttttggagcttgtttttgcccttgatagcacgtatccttagagaataagcttgccaatttaaggcctgtctgtaatggcatctgaatgttccagcagcctaactgtgctctgctccagaaacatgtgtgtggcttccctacctccacaccaaggagctgccttgctgggtggatgtaaagactgtcctgccagggtttcccactaaaggtattaataagtccagtggaccacagagggcccaatccctcttggccgctaaggctaaggtaggagccagagagctgtagagacaggaccaccaggatgcttcatgtccataacacaagagagcgctgcattgtttgggggccaggcattactactatcatgaagaaaaatgaagagcaggatgcatgttagtctttaattcacttttaatagtataaacctcatttaggtagtagtattaagccacaacaataatgccacattgaaacagcatttaataaaatgcataaagctaattcatgcactgcaatactctatatacaaacacaacaatgcaaattcttcttcaagactgaagacattgattagatataaaattcagtttaaaaagaacatgctattttttaaatgccatcacataaacaaagtgatttcacagggagaagaaagctgtataaagctgcagctttcaacaggttttaaacctggcattaaaatgtaatggcaaaaccaatattttctatattgtgaagggcaaaggttacagaaacggtcccaagaaaatctaacacccaaattttcctttgatagatagatgcctttaaaagggctggtaatgcagttacattctaacagagaagtccaaactacaggtaaaaactacggcttgtactgtgaaaaatgtgcagcttttcagttataaaactagttgaacactggtttacaagataatccgtagaacagagagactgtagaaaaatattccagcacttgagttgtgtgtggcagcagcatttgagtccatgaatgctatggtcattaaaataattgattatactttcctaaagaaaagccattttttaatgcaaagtctactacttccaaatgttattccaaacattaaattttaacagtctatcaatcaataaatgttgaacattttttttctattttgcatgtataaatatcaagacaccaaaattatttatagctgggcattaaaaatatctgacatttttctccccgcaaagatacttttcttaagctcacactttaattatttgtagactgctgttaagctaaatagccccaaaggaaacttttaattcatttagagactgtcaagtttccaattgcattttaactagaaagccactttcaatagcgtgattgtcacgacaggctatgacggggaaaggtcgcacaatcttgtgggatgaggccagtgaaatagaagctttctctacatcaaaaacagggaagctgaaggctaaatgacccactgtctcacaaaaggcactgagtactatggtctcataaagtgtttttaaaacattttgataacttattttaaaaagaaaaagaggaaactgtggattatgtgagtttttgcagcaatctagtgattccttccagcaggcccctgcttcccaggtctatgagcaactactgctgggccaggccctggctctcaagggccgagtctcagtttaaggccagattaagggggaaaattcgtccgagtagacctggacgaggaaaatttggtatctgtagcttttaagggcacacatatccatattaaaatgcaattcttatctgaaaatttaaaatcataacttatagaaaggagttaaagtcatttacatgcttacagttagagaagtaacttgagatctgtagcttatatgccgcagaagttagccatcaacatccatgcttagttttaaagaataatacttggtaggttgtttatttttaactggcgatagaaagatgggaattactatttattcagtcataggacagtgccccacatcttgctgactgagcacagcgcaagcctgggaaattgctaccatctttgggagtcaggcctcactgacacagaccgttctgaatctctgaccgtgacgcctgtctctgggctactcaacagagctgaatagctgggaaggctgatggctcaacccaactgccaagttccttccaggtagggccatgaataggtgcatgaaaaggttaaaaattcccacttagttttggatattaagataaactgtcttccagcttcctggctcttgtccgaacctagagaatatacggaaatgtcaccctgtcagaacctcttctgcctggaattcttccttttgcagagtggagattctgacttcatggcccttcccaggcaggctcacccaaaggaaaatggagtgaagaaaatcaccagcaaatcttccctgccgagggaccttggaacacccatatcagtttacattagcaactttatgaaaaactctctttaaaggaaagtttggatacatgtctgtatacataatatacatctatgtacacatacacacactatatacactgtacatatggagaggatataaacacatgtacattcattcagtcttacagcctagaaacctgtacacgcacaatgctgctgaagggacccagggctggacatacgaagtgcacgctggtgggaggcacacaatgagaaggtccagaccctgtgtacaaaagacccaaaccaaccctgtcttgatgaggggttggctttaaaaatttacatcaaagttaagacattttcaaagagcctcataactgagagaatggaagctggataaaggaagcacgtggggcatctgctctgctggctcaggcattcccagggcccagtgggcaccgccttccctgggagaaaagtggctgtcagatgatgagacttcctatgacctggactaagaaaagagttaaaatgttacctatgaccccattgcacataaagtcatttacactggaaagtgggcaacaagcttctggactccaatgagatcaggtcccagaacatggatgtacacatgtggcatgaactgctgattgcggccaggggctggaagccctgcagagggcgggctgtgagcaagagtgctctgcaggaaatgtcctcaaaggactatgaaagtaaaagcactagaaacagctagagtccttagaattttttgctccttgccgtaactatcccccaaacaagtaagacagctaataagtatgtgtgtagcgtggatattgccttgagattaaggagcctaacgcatccactgttaacaccatggctggtgtcctaactgcctcagaagagtccacattcaatactgacaatgacaagctaaaaatcagtccctcttgagggcaattacacatcttagaagtgactacacctgaaattaaatataaagcccagaacagcaaaagaacctcaaaccacagccttatggcaagggttagacaataaatgtaactcctcaggacacagaaatgtcaaattaggagagtatggtaggtaacacacttccttaaaaacaccttccaggagtaacttgaaaagtattacttgctcaactaatttggtctttcaaaaaatctcttcctgtcctgttttatgctaatgtgtaatgatctccaccattttcaacatctatctgtcttaacccaacattatctgagatacttctggaaaagagctcacttaactgatgacagcatgtgtctgtcccacctctctgagccagctgcctctcctcattgagggaggagcagccag

SEQ ID NO: 373457 - DNA, 4886 bp, Homo sapiens
tatgatagacgtgacggaagaggagaggtaaagtagaaggtctatgatcttgtctgtctgctgtcacaatttgtgtgtgggtggaaaaagctctcctccacagagagccctcccatgtctgctggtttcagttccccacccaactgactgaagtcttgaccttgataccacctgcctgggcgttctacttggctgcaagggctcttcagaaagcacctagttccttttggctttcatctgcagtgtaggtctccatagctagtgacacacaaagccttatgagagtattccttccctctagggcccaaagaggctgctaaccagcaggaatgtcctgaaccaaaaggagtggtgaccattctctagacagaataaatgtctggtccctaatgggacagataactagggtttgagttcaggcttgacacaggagcaatgggcagtgaggtggacagcccagaccctgaaaggacgtgtggagacagcagcagtcctgtggtgcagttactgcctgtgtggccagcttcacaggcagcagataatttgtggaaataaacattattttctttttttgttccctgtaggctacttgatcctggatagtttctctttaaacctttgtctttccctattttgtttagtagtgatgaaagatgggtttaaaatatacagaaatgggagaaaattaattagagaaaatgtgaggattttataattgataacatgttcttaattttacttgcacaagcagtgttcacagccttattctgaagtgaccacttttcttctctttgaggcactacctggcagcaccatctaaacctgtatcatctgctgtggtcccagttactcaggaggctgaggcaggaggatcacttgagcccaggaggttgaggctggagtgagccatgactgtaccactgcattccagcctgggtgacggagtgaggccctatctgcctgccagtgagttctgtcatgcatcagactttggacctcagaattttcacctggaacatgagaggtcagatgacataatgaatatgttctaacttctgaaacttttggagcttgtttttgcccttgatagcacgtatccttagagaataagcttgccaatttaaggcctgtctgtaatggcatctgaatgttccagcagcctaactgtgctctgctccagaaacatgtgtgtggcttccctacctccacaccaaggagctgccttgctgggtggatgtaaagactgtcctgccagggtttcccactaaaggtattaataagtccagtggaccacagagggcccaatccctcttggccgctaaggctaaggtaggagccagagagctgtagagacaggaccaccaggatgcttcatgtccataacacaagagagcgctgcattgtttgggggccaggcattactactatcatgaagaaaaatgaagagcaggatgcatgttagtctttaattcacttttaatagtataaacctcatttaggtagtagtattaagccacaacaataatgccacattgaaacagcatttaataaaatgcataaagctaattcatgcactgcaatactctatatacaaacacaacaatgcaaattcttcttcaagactgaagacattgattagatataaaattcagtttaaaaagaacatgctattttttaaatgccatcacataaacaaagtgatttcacagggagaagaaagctgtataaagctgcagctttcaacaggttttaaacctggcattaaaatgtaatggcaaaaccaatattttctatattgtgaagggcaaaggttacagaaacggtcccaagaaaatctaacacccaaattttcctttgatagatagatgcctttaaaagggctggtaatgcagttacattctaacagagaagtccaaactacaggtaaaaactacggcttgtactgtgaaaaatgtgcagcttttcagttataaaactagttgaacactggtttacaagataatccgtagaacagagagactgtagaaaaatattccagcacttgagttgtgtgtggcagcagcatttgagtccatgaatgctatggtcattaaaataattgattatactttcctaaagaaaagccattttttaatgcaaagtctactacttccaaatgttattccaaacattaaattttaacagtctatcaatcaataaatgttgaacattttttttctattttgcatgtataaatatcaagacaccaaaattatttatagctgggcattaaaaatatctgacatttttctccccgcaaagatacttttcttaagctcacactttaattatttgtagactgctgttaagctaaatagccccaaaggaaacttttaattcatttagagactgtcaagtttccaattgcattttaactagaaagccactttcaatagcgtgattgtcacgacaggctatgacggggaaaggtcgcacaatcttgtgggatgaggccagtgaaatagaagctttctctacatcaaaaacagggaagctgaaggctaaatgacccactgtctcacaaaaggcactgagtactatggtctcataaagtgtttttaaaacattttgataacttattttaaaaagaaaaagaggaaactgtggattatgtgagtttttgcagcaatctagtgattccttccagcaggcccctgcttcccaggtctatgagcaactactgctgggccaggccctggctctcaagggccgagtctcagtttaaggccagattaagggggaaaattcgtccgagtagacctggacgaggaaaatttggtatctgtagcttttaagggcacacatatccatattaaaatgcaattcttatctgaaaatttaaaatcataacttatagaaaggagttaaagtcatttacatgcttacagttagagaagtaacttgagatctgtagcttatatgccgcagaagttagccatcaacatccatgcttagttttaaagaataatacttggtaggttgtttatttttaactggcgatagaaagatgggaattactatttattcagtcataggacagtgccccacatcttgctgactgagcacagcgcaagcctgggaaattgctaccatctttgggagtcaggcctcactgacacagaccgttctgaatctctgaccgtgacgcctgtctctgggctactcaacagagctgaatagctgggaaggctgatggctcaacccaactgccaagttccttccaggtagggccatgaataggtgcatgaaaaggttaaaaattcccacttagttttggatattaagataaactgtcttccagcttcctggctcttgtccgaacctagagaatatacggaaatgtcaccctgtcagaacctcttctgcctggaattcttccttttgcagagtggagattctgacttcatggcccttcccaggcaggctcacccaaaggaaaatggagtgaagaaaatcaccagcaaatcttccctgccgagggaccttggaacacccatatcagtttacattagcaactttatgaaaaactctctttaaaggaaagtttggatacatgtctgtatacataatatacatctatgtacacatacacacactatatacactgtacatatggagaggatataaacacatgtacattcattcagtcttacagcctagaaacctgtacacgcacaatgctgctgaagggacccagggctggacatacgaagtgcacgctggtgggaggcacacaatgagaaggtccagaccctgtgtacaaaagacccaaaccaaccctgtcttgatgaggggttggctttaaaaatttacatcaaagttaagacattttcaaagagcctcataactgagagaatggaagctggataaaggaagcacgtggggcatctgctctgctggctcaggcattcccagggcccagtgggcaccgccttccctgggagaaaagtggctgtcagatgatgagacttcctatgacctggactaagaaaagagttaaaatgttacctatgaccccattgcacataaagtcatttacactggaaagtgggcaacaagcttctggactccaatgagatcaggtcccagaacatggatgtacacatgtggcatgaactgctgattgcggccaggggctggaagccctgcagagggcgggctgtgagcaagagtgctctgcaggaaatgtcctcaaaggactatgaaagtaaaagcactagaaacagctagagtccttagaattttttgctccttgccgtaactatcccccaaacaagtaagacagctaataagtatgtgtgtagcgtggatattgccttgagattaaggagcctaacgcatccactgttaacaccatggctggtgtcctaactgcctcagaagagtccacattcaatactgacaatgacaagctaaaaatcagtccctcttgagggcaattacacatcttagaagtgactacacctgaaattaaatataaagcccagaacagcaaaagaacctcaaaccacagccttatggcaagggttagacaataaatgtaactcctcaggacacagaaatgtcaaattaggagagtatggtaggtaacacacttccttaaaaacaccttccaggagtaacttgaaaagtattacttgctcaactaatttggtctttcaaaaaatctcttcctgtcctgttttatgctaatgtgtaatgatctccaccattttcaacatctatctgtcttaacccaacattatctgagatacttctggaaaagagctcacttaactgatgacagcatgtgtctgtcccacctctctgagccagctgcctctcctcattgagggaggagcagccag

SEQ ID NO: 373458 - DNA, 2985 bp, Homo sapiens
ctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgaggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttcctaatagcagcttggcgtgtatctggtcctagtgaagaggaaggcctgtgtagcagaaaggctttgggcctgagaggttaaggccacagcctgttgacacctgttttggtcctgcgaccctttactggtctccgctggctttgaatcttcctctgggctctactctggagaacataagggctgctgtggttgagtctggctagcactgtctgtggttggcagtgtgtacacccctccgttcagttccttgggggtatttttcagaaatccaaaggcaacccttcgtgcagtgctcacttttttaagtacagttgattacccttgcctgctggggggcctagccatgggccagagatggaggagccccagtggctgacaggccagcctcactcaggcacgtacctgctgaccagtcagccactgccaacccatggcccagccactgtgtgcattagcagggaggtttgtaggccatggaggaaatgaggagacaccacctagtggagacattggggccctgctggggggatggtgtctatagctggctctgctggctccctcaggccctgcttaccaagctctggaggagggagtgctgcattactgagcaccttccttgttctttcctcataggacactgatgttactgtcactttagttatgctaaagtggaggtttcagcctccagaagacagcagagccttctagggtcaccttaagaataggtttagctaggctgggtgtggtggctcatgcctgtaatcccagcactttgggaggctgatgtgggcggatagttgagcccaggagttcgagaccagcctgggcaacatggcaagaccttgtctctacaaaaagtacaaaaattagatgggtgtggtgtttcgcgtctgtagtcccagctatttgggaagctgaggtgggaggatctcgagcctgcgagatcaaggctgcagtgaatcatgatcgtgcgctactgcactccagcctgggccacagagcaagactgtctcaagaaaaaaaattttttaaataagtttaattataaagtgaaggaccagttggaccacggacccctagaaactcagccaaggagacctgactttatctgagacaggaaggcagtggttaaaagaattaaaaaaggacagtggtgcttgacagagcaggactgaagttttcattcctctacctgctggggccttggtcaagtcctaaaagctttccaggtctgtaactggttttgtctgtaaaatggggaaaaggttaccttttctgccacatgaagtagctggctggtgaaatgatgtcatactacgatgtgtttcattaactgttggagattatcacattaaattgagcagatttggatcttttacatttgatgctcaagtttgattctgtaccagatctgggtttggggtgatggcttgtcgggggtgggaggggaaggtgggcagagactgatgtataatggacaggtgttccttgagtgacagacttacaaagggagtgtttaattgaaatctagcatcttgtctctctgctatcagcattttggctgggtggaaaaagctctcctccacagagagccctcccatgtctgctggtttcagttccccacccaactgactgaagtcttgaccttgataccacctgcctgggcgttctacttggctgcaagggctcttcagaaagcacctagttccttttggctttcatctgcagtgtaggtctccatagctagtgacacacaaagccttatgagagtattccttccctctaggggccccacaaaggaggctggctaactcgagacaagggaaattgtccgcttggaaaacccaaacaaagggcagtcggttgaacccaattttacttccttaggacgaggacaagttcacacccttggtccctgggttccccccttcaatagtgggggggaccacaggattaaaaccttaaaggaggcttttatggaaggtttcaaagggcctttttggaacccacccaacgggcaaaggtccaaaacttggggtggcaaaggttggaaggggttggcgaaacacagagcccccaagtaaaacccccgtggcacaaacggggcaaccaggttgggttggggcaagaaa

SEQ ID NO: 373459 - DNA, 736 bp, Homo sapiens
cacacagaggccttttcaggctcctttatcttgtgattgcatgtgagagctgtgggctccacctgtggcagcagataggctgaccgcactgtgtaggcttgctgctgtggtgtgaggggacaacagcaggccttctttcagcgctctcctcaggggccagcagggagacagcgataggctttgacagtgaggatcaggttagaaggcaggagatccaggtgtccctggtggatggtggggttgtctcggctgagaaactgccctgtgcctgccactcaaagttgccaatgcttggttgccgtctgtgctctttggcagggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttcc

SEQ ID NO: 373460 - DNA, 1013 bp, Homo sapiens
ctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgaggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttccggttctatagcaaaaaaaaaaatttggggccgcacgttgaggggggggaggcccacgggtggacgaaaacgggagggggagtgggtgggaaggctatagtagaggaaggggcccaggtggaaattggaggcggaagggttgttaagaagaaatgggcgg

SEQ ID NO: 373461 - DNA, 4438 bp, Homo sapiens
ctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttaggcactacctggcagcaccatctaaacctgtatcatctgctgtggtcccagttactcaggaggctgaggcaggaggatcacttgagcccaggaggttgaggctggagtgagccatgactgtaccactgcattccagcctgggtgacggagtgaggccctatctgcctgccagtgagttctgtcatgcatcagactttggacctcagaattttcacctggaacatgagaggtcagatgacataatgaatatgttctaacttctgaaacttttggagcttgtttttgcccttgatagcacgtatccttagagaataagcttgccaatttaaggcctgtctgtaatggcatctgaatgttccagcagcctaactgtgctctgctccagaaacatgtgtgtggcttccctacctccacaccaaggagctgccttgctgggtggatgtaaagactgtcctgccagggtttcccactaaaggtattaataagtccagtggaccacagagggcccaatccctcttggccgctaaggctaaggtaggagccagagagctgtagagacaggaccaccaggatgcttcatgtccataacacaagagagcgctgcattgtttgggggccaggcattactactatcatgaagaaaaatgaagagcaggatgcatgttagtctttaattcacttttaatagtataaacctcatttaggtagtagtattaagccacaacaataatgccacattgaaacagcatttaataaaatgcataaagctaattcatgcactgcaatactctatatacaaacacaacaatgcaaattcttcttcaagactgaagacattgattagatataaaattcagtttaaaaagaacatgctattttttaaatgccatcacataaacaaagtgatttcacagggagaagaaagctgtataaagctgcagctttcaacaggttttaaacctggcattaaaatgtaatggcaaaaccaatattttctatattgtgaagggcaaaggttacagaaacggtcccaagaaaatctaacacccaaattttcctttgatagatagatgcctttaaaagggctggtaatgcagttacattctaacagagaagtccaaactacaggtaaaaactacggcttgtactgtgaaaaatgtgcagcttttcagttataaaactagttgaacactggtttacaagataatccgtagaacagagagactgtagaaaaatattccagcacttgagttgtgtgtggcagcagcatttgagtccatgaatgctatggtcattaaaataattgattatactttcctaaagaaaagccattttttaatgcaaagtctactacttccaaatgttattccaaacattaaattttaacagtctatcaatcaataaatgttgaacattttttttctattttgcatgtataaatatcaagacaccaaaattatttatagctgggcattaaaaatatctgacatttttctccccgcaaagatacttttcttaagctcacactttaattatttgtagactgctgttaagctaaatagccccaaaggaaacttttaattcatttagagactgtcaagtttccaattgcattttaactagaaagccactttcaatagcgtgattgtcacgacaggctatgacggggaaaggtcgcacaatcttgtgggatgaggccagtgaaatagaagctttctctacatcaaaaacagggaagctgaaggctaaatgacccactgtctcacaaaaggcactgagtactatggtctcataaagtgtttttaaaacattttgataacttattttaaaaagaaaaagaggaaactgtggattatgtgagtttttgcagcaatctagtgattccttccagcaggcccctgcttcccaggtctatgagcaactactgctgggccaggccctggctctcaagggccgagtctcagtttaaggccagattaagggggaaaattcgtccgagtagacctggacgaggaaaatttggtatctgtagcttttaagggcacacatatccatattaaaatgcaattcttatctgaaaatttaaaatcataacttatagaaaggagttaaagtcatttacatgcttacagttagagaagtaacttgagatctgtagcttatatgccgcagaagttagccatcaacatccatgcttagttttaaagaataatacttggtaggttgtttatttttaactggcgatagaaagatgggaattactatttattcagtcataggacagtgccccacatcttgctgactgagcacagcgcaagcctgggaaattgctaccatctttgggagtcaggcctcactgacacagaccgttctgaatctctgaccgtgacgcctgtctctgggctactcaacagagctgaatagctgggaaggctgatggctcaacccaactgccaagttccttccaggtagggccatgaataggtgcatgaaaaggttaaaaattcccacttagttttggatattaagataaactgtcttccagcttcctggctcttgtccgaacctagagaatatacggaaatgtcaccctgtcagaacctcttctgcctggaattcttccttttgcagagtggagattctgacttcatggcccttcccaggcaggctcacccaaaggaaaatggagtgaagaaaatcaccagcaaatcttccctgccgagggaccttggaacacccatatcagtttacattagcaactttatgaaaaactctctttaaaggaaagtttggatacatgtctgtatacataatatacatctatgtacacatacacacactatatacactgtacatatggagaggatataaacacatgtacattcattcagtcttacagcctagaaacctgtacacgcacaatgctgctgaagggacccagggctggacatacgaagtgcacgctggtgggaggcacacaatgagaaggtccagaccctgtgtacaaaagacccaaaccaaccctgtcttgatgaggggttggctttaaaaatttacatcaaagttaagacattttcaaagagcctcataactgagagaatggaagctggataaaggaagcacgtggggcatctgctctgctggctcaggcattcccagggcccagtgggcaccgccttccctgggagaaaagtggctgtcagatgatgagacttcctatgacctggactaagaaaagagttaaaatgttacctatgaccccattgcacataaagtcatttacactggaaagtgggcaacaagcttctggactccaatgagatcaggtcccagaacatggatgtacacatgtggcatgaactgctgattgcggccaggggctggaagccctgcagagggcgggctgtgagcaagagtgctctgcaggaaatgtcctcaaaggactatgaaagtaaaagcactagaaacagctagagtccttagaattttttgctccttgccgtaactatcccccaaacaagtaagacagctaataagtatgtgtgtagcgtggatattgccttgagattaaggagcctaacgcatccactgttaacaccatggctggtgtcctaactgcctcagaagagtccacattcaatactgacaatgacaagctaaaaatcagtccctcttgagggcaattacacatcttagaagtgactacacctgaaattaaatataaagcccagaacagcaaaagaacctcaaaccacagccttatggcaagggttagacaataaatgtaactcctcaggacacagaaatgtcaaattaggagagtatggtaggtaacacacttccttaaaaacaccttccaggagtaacttgaaaagtattacttgctcaactaatttggtctttcaaaaaatctcttcctgtcctgttttatgctaatgtgtaatgatctccaccattttcaacatctatctgtcttaacccaacattatctgagatacttctggaaaagagctcacttaactgatgacagcatgtgtctgtcccacctctctgagccagctgcctctcctcattgagggaggagcagccag

SEQ ID NO: 373462 - DNA, 4496 bp, Homo sapiens
ctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgaggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttcctaatagcagcttggcgtgtatctggtcctagtgaagaggaaggcctgtgtagcagaaaggctttgggcctgagaggttaaggccacagcctgttgacacctgttttggtcctgcgaccctttactggtctccgctggctttgaatcttcctctgggctctactctggagaacataagggctgctgtggttgagtctggctagcactgtctgtggttggcagtgtgtacacccctccgttcagttccttgggggtatttttcagaaatccaaaggcaacccttcgtgcagtgctcacttttttaagtacagttgattacccttgcctgctggggggcctagccatgggccagagatggaggagccccagtggctgacaggccagcctcactcaggcacgtacctgctgaccagtcagccactgccaacccatggcccagccactgtgtgcattagcagggaggtttgtaggccatggaggaaatgaggagacaccacctagtggagacattggggccctgctggggggatggtgtctatagctggctctgctggctccctcaggccctgcttaccaagctctggaggagggagtgctgcattactgagcaccttccttgttctttcctcataggacactgatgttactgtcactttagttatgctaaagtggaggtttcagcctccagaagacagcagagccttctagggtcaccttaagaataggtttagctaggctgggtgtggtggctcatgcctgtaatcccagcactttgggaggctgatgtgggcggatagttgagcccaggagttcgagaccagcctgggcaacatggcaagaccttgtctctacaaaaagtacaaaaattagatgggtgtggtgtttcgcgtctgtagtcccagctatttgggaagctgaggtgggaggatctcgagcctgcgagatcaaggctgcagtgaatcatgatcgtgcgctactgcactccagcctgggccacagagcaagactgtctcaagaaaaaaaattttttaaataagtttaattataaagtgaaggaccagttggaccacggacccctagaaactcagccaaggagacctgactttatctgagacaggaaggcagtggttaaaagaattaaaaaaggacagtggtgcttgacagagcaggactgaagttttcattcctctacctgctggggccttggtcaagtcctaaaagctttccaggtctgtaactggttttgtctgtaaaatggggaaaaggttaccttttctgccacatgaagtagctggctggtgaaatgatgtcatactacgatgtgtttcattaactgttggagattatcacattaaattgagcagatttggatcttttacatttgatgctcaagtttgattctgtaccagatctgggtttggggtgatggcttgtcgggggtgggaggggaaggtgggcagagactgatgtataatggacaggtgttccttgagtgacagacttacaaagggagtgtttaattgaaatctagcatcttgtctctctgctatcagcattttggctgggtggaaaaagctctcctccacagagagccctcccatgtctgctggtttcagttccccacccaactgactgaagtcttgaccttgataccacctgcctgggcgttctacttggctgcaagggctcttcagaaagcacctagttccttttggctttcatctgcagtgtaggtctccatagctagtgacacacaaagccttatgagagtattccttccctctagggcccaaagaggctgctaaccagcaggaatgtcctgaaccaaaaggagtggtgaccattctctagacagaataaatgtctggtccctaatgggacagataactagggtttgagttcaggcttgacacaggagcaatgggcagtgaggtggacagcccagaccctgaaaggacgtgtggagacagcagcagtcctgtggtgcagttactgcctgtgtggccagcttcacaggcagcagataatttgtggaaataaacattattttctttttttgttccctgtaggctacttgatcctggatagtttctctttaaacctttgtctttccctattttgtttagtagtgatgaaagatgggtttaaaatatacagaaatgggagaaaattaattagagaaaatgtgaggattttataattgataacatgttcttaattttacttgcacaagcagtgttcacagccttattctgaagtgaccacttttcttctctttgaggcactacctggcagcaccatctaaacctgtatcatctgctgtggtcccagttactcaggaggctgaggcaggaggatcacttgagcccaggaggttgaggctggagtgagccatgactgtaccactgcattccagcctgggtgacggagtgaggccctatctgcctgccagtgagttctgtcatgcatcagactttggacctcagaattttcacctggaacatgagagggaactgcaacatggccctcatggtcactctcaaggatcaaaacgacggaaggcaggcaacaatctgtgttagaggcaccactgagctgcaggatgcctgctactaaaagccttcacaagcagaaatgaaacaaacctgccctaattccattgtctcagctggttttttgtcttaattttgaaactgaaaacacatcagggttagaaaagtaaaaattactttaagctggcaaaattaaatcctttccatcattttataatggccactcccactactctccaaaatttgctgccaaggcaagaattataaaatgatataattaaatccaaacaagaatttagaagttggaaacactgttcccacttaccctactaacactgacttgcgtaaagtgctgctaacccttcaggatcaagcatcctgttctgccttgagcctgcagcagcttccattctgtccaatgtggcaccacaggggcgtctgtagctggccagactgcacccctgtggagcacatgtggcgccagcctgagccagatcagagcacctgtgagtcaggggagtgtccagggatctttttggatatcatctgattaacaaatcaagagaggcaaatttaacccaacagggtgtattttcttaatctggactatttaaaaagcaaaagacaaagcaattgaccgggtcttccacatgccactgttctcaaacaggaaaagcttgctatatattcacatccgtgggaatttacgggtgtttgaagttagacataacttccttttaagcgcatactgttcttgctgtaaactctggttgctacaatttatgaggagaaagactatcaccctggaaattgagggttgtttttaaggagcaagcagcctgcatttaaaatgctccggggtggtcggctggcacacacctgggggaaccaaagtgcacagtgtgctggtaacattaacagacttgccaacagagatgctgagtctatacacatttttaaaatctctggtatttaaggtcaacaggaagaaattgtcctgaaaccttccatccagctttaccaggccctaaccactctcgccaggcggcagcaggctcctgcccagccccaatccagcctcacagttatga

SEQ ID NO: 373463 - DNA, 1166 bp, Homo sapiens
ctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgaggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttccaaaaaaaaaaaaaaaaaaaaaaaaaaaaaaaaaaaaaaaaaaaaaaaaaaaaaaaaaaaaaataaaaaaacaaaaaaaaaaaaaaaaaaaaaaacctcagggtccaaggcatctaaaagctgaatttgaaacttcacacagggctgcttgaaaaaaccctctcagggaacagacttcccaaattctcccaaaaacccttggtaaaacggcaacaatcttttaaactttggaaagtcacttaaaaataccattccaaaagacttaaagcctgaaacaattactttaataggaatatatttcaccacttttaag

SEQ ID NO: 373464 - DNA, 410 bp, Homo sapiens
gaaaccctgtctctactaaaatacaaaaaattagctgggcgtggcagcgtgcatctatagtcccagctacttgagaggattgcagggagccgagatcgcctgggtgacagagtgagactctgtctcaaaaaaaaaaaaaaaaaaaaaattaccctggtgtggtggctcacacctgtagtcccagctactcgggaggctgaggcaggagaatcgcttgaacctaggaggtggaggttgcagtgaactgaggtcaggccactgcactccagcctgggcaacagagtgagactcagtttcaacaacaacaacaaaaaagaattcttatagcgtgtaatctccagtccctgcttccccttcccagggtctttctggtgaccagctcatcctgaagctatctagggcccccaccc

SEQ ID NO: 373465 - DNA, 723 bp, Homo sapiens
gagcggtttggcggagacacagggccgctcagaggccgccgcaatgctcccctctttgcaggagtcgatggatggagatgaaaaggaactagagagcagcgaagagggaggctcagccgaggagcggagactcgagccgccgtccagcagccactactgtctttacagctatcgcggaagcagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagctatatcctttctttggtttttgagaacatcaggaaggaaaacatgggaaggcaggtggaagaatattactaccaacctccaaaaagcttttctactcctcgtgtatttagttgaatttcataccttcatgtggccattttgccttggcttgtttgcatttgcagctcacattatttgagagattttatat

SEQ ID NO: 373466 - DNA, 2532 bp, Homo sapiens
gataaaagaaaccacattataggaaacaccggaattttacagaccgttcgagcaatacacatatacttaggaaacaaacatcaaagcccgggtttccgatcttttacttactaaccgcctgccctgggcgagtaactgatggatcatctgtttttaaggcagaggagaaccgtgctttccagccagcacggggagcaacatgaatgatgccaggaaaggctttcacggcacccagggaatctgcattacgtatttgcaaattaaattggacgctgggggaagatcctggtgtggtgagcaacagctcccctaatcctctgggcaagaatggttctcatggaaatcgagagtcctattagctggcaaaagagcctcattagggagcttttcctaattaaaaaacgaatgatgaatggtgtcattaaagcgaaatttctcctttgaaggtttgttttcccttccccagtttctgtgattcctctcccgtttaatgagagccagtgagtctatggctgctgtttggggattccccagctttcagtttctgtatcctgtggataaaaggccaacctacctccaccagcctgaagatttacacaccaccccctgggctggcagccacctcagacaaggaaagaggcacagaggacacggccagccttggccatggggaagtgctgctgagagggtggtgggacctgctgaggagaaagccagatgccacaaagagaacccctctgaccagacagctgcctcctgacctggggagaggcctgggtcaggtgaagtgaccctatgaccccaccctgtggccccgcttggaagtcatggttgggagaggggatggaggtgggtgtgctgacagagaacagctggggctggtggtctaaggtgtagacgagggtccttggcagcagaggacacacttaacatggtgggagacacgattccgcctccactgtccttctcagtaacaagcttccctgggagtccccgagggagctgagtgcttctatgagggatttctagaatcttctagttcaatgctttctcacccctaagagaggaagccccctctccaggtcataccagacagaggtggcactctgctcattccacccacaccacagaatccccaggggccaggacaggaatctggaggggattctccatccctccaggaaaggacctcatcgctcagcttagtgcggctgcagcccaggcagaggcagcaatgtcctgactccttctgcatcctcccctggtcttccctgagcccagctccacagcctcagagcctcctcctctgaggcactgacttccatctacatctttctatcactagggcagagaacggtgggcagggcacacacaagacgccccaggctgacgcaacaccgccaaaggcgtgggcccacagtgccacaggctgcggccctcagcatggcactggtgcaggggagcaggacctagggaactacatatgtggatgaggccagggcaatctatttagcagtgggccaagatgcggtatggctgggcctcgcctgccagtgagtgagtgagcccatttacatgtagtcaccaggatgggaagccactgtggcccaagaccccaaatgcctggcctgactgaccctggaccctgctacactcaagggccaggatgggcaccaggctggaggaagaccgttcccacactcctgcccctgtttctggacacgcccagcccccctgcctcctcccaggcctggcgttctttgttcttctgggctgtcagtggttgagaattccaagagcacgataaagggagtgtcatcttttgtcaaaggtcatcctcatgccctccattcggggcctgcaccagctcctgttaggagggtcattccctccatcttgttttctcacctgtgtaatggggtggggtggatttgataaccaccatgttctctcccgcatccaagcctccgaggctactggctgccctccctctgaggttcatccatgcacccaacaattctcctgaggcaaagttttccaactaaactggaattcctcttcctgtagcctcctgtccccctaacttaaatggacacatggcctcaacattcctaccccagcctctcttgcgcccccaaagctctttctctcctaagggagataggatggaacctttttggatatgaaggccatctcagacggaaacaagagctgaacctggcaaacctcagcatccagggatccttggagggcttgagctctccctccagcagggccattctgccaccggtcagtgatgctcaggggcaggtgtggaagggacaggagatgggaaggaagggggcaggctttgtcaaagcaaggacattcagcaaccacagcacaccacggtctgccacctctcacggatgcccacatgggccccctgcatcctccatgccttctctgcaggcgctgtcgtgcctcagttacctttcccatcacatacacacatatacgcacacacacacacacacgcatgaatgtttcaaa

SEQ ID NO: 373467 - DNA, 773 bp, Homo sapiens
ttctagttcaactcagaccgtgaagttagcatacaggtcctcaggagtttgaggccacttcccaaggataaggccaccttcaggcacatctgccttaaacatcaatttgtgaagctttgggagaggggagaacatacttttttttaatataaacatgggtatgaactagagtgaaatttgtgtgaatttttcacataagacaggagaattcaaagaaatttcatgtatgttagtggctgctttaactaaagccctccagggtatacattcatttttctttgctgctgcaagtacaccaacgagaagtctgggaagctctgagttagtgggcagtttaatggtgttgccagatcaagatgaccagaattcagagcagtccacaaaattatagatgcatgagtaaccaaaataatgcattttacattttctttcttttctagaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagctatatcctttctttggtttttgagaacatcaggaaggaaaacatgggaaggcaggtggaagaatattactaccaacctccaaaaagcttttctactcctcgtgtatttagttgaatttcataccttcatgtggccattttgccttggcttgtttgcatttgcagctcacattatttgagagattttatat

SEQ ID NO: 373468 - DNA, 529 bp, Homo sapiens
gcgacccataactgtgttctaccggcaaagtaaaagggaggagaaaagaagcaggagaaacgaggccaaaaatccctcactttcccaacccaacggctaccaccacgtcccacaggaagcagacacaaaatggccgacggcctcgttccccgctccgcctcccgtcaagcactgcggtaggagcggagccaagaaggggagggtcacatgacgcagacctccgccctgagtgggtgggactaagaggcgcgaagaggtggcagccatcttgtccgtttcagagtttttcgctttcgctggctgtgcttgcggagcactttgggtttcatttgtaaaggagccggagccccaggtacgctaaggggcatgcgaatggaaaacagaaaacaaaaaaacggaaaagattgccagtgcagttagggccgatcacaaataaagatagagacagcgcccaattttaattttgtttcaattgaacagtaaatgttgattatgtgcctattaaatgctaaaccaaaataagttagtc

SEQ ID NO: 373469 - DNA, 1796 bp, Homo sapiens
gagcggtttggcggagacacagggccgctcagaggccgccgcaatgctcccctctttgcaggagtcgatggatggagatgaaaaggaactagagagcagcgaagagggaggctcagccgaggagcggagactcgagccgccgtccagcagccactactgtctttacagctatcgcggaagcagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtaaagaacagttttttcaaagagaaaagcttttccacagcaagattgacatctgtgtttgtaaactgctccttccatcccttccccaccagcccagtgcaaaataaatttgttttcatccttccgtcctgcaatattgtttgtggaaatggacttgtgtgtgtggcaggtttctgagtgtggccagtcttcaaggacttattcatgaaggcaccatgacttctttgtgcatggccatgacagaggagcagcataagtctgtggtcatcgattgcagcagctcccagcctcagttctgcaatgcaggaagtaaccggttttgtgaggattggatgcaagcttttttaaatggtgccaaaggaggtaacccttttcttttccgacaagtactggagaactttaaactaaaggccatacaagacacaaacaatttgaagagatttatccgacaggcagaaatgaatcattatgctttgtttaaatgttacatgttcctaaagaactgtggtagtggagatatacttttgaagattgttaaagtggaacatgaagaaatgcctgaagccaaaaatgtgatagctgtccttgaagaattcatgaaagaagctcttgaccaaagtttttgatcatatgttttgagataattgtatgatcaagttgtatatttaagtcttagtgtttgaaattgcagttataattgttcataggattgctatttaagatgatttgaaactcaatccagattttctttttgtattttaccaatttaacttaaataaaaatctgaagaacatcttcactgagtcctagatagataatgtatgtgagagttgtgaaattttagtgtctcactggccccataaattccacgcttcaggaagttgttgcttaaaaaatttcagagatgattttgtttgtggcttttctcaggaaaagcctgagtttgctgcagtatttagcaacttttcttctcagaaaaaccataatacttccttttcagtggactgtagcttcttaaa

SEQ ID NO: 373470 - DNA, 3582 bp, Homo sapiens
gagcggtttggcggagacacagggccgctcagaggccgccgcaatgctcccctctttgcaggagtcgatggatggagatgaaaaggaactagagagcagcgaagagggaggctcagccgaggagcggagactcgagccgccgtccagcagccactactgtctttacagctatcgcggaagcagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggccatgacagaggagcagcataagtctgtggtcatcgattgcagcagctcccagcctcagttctgcaatgcagaaatcctggatccaccaccgctgctgttcaccctctcccacccatcctgacccagacccagatgaaacaggccctaatgccagcccttcaggtcacttcctgaataaccaatggcttggaaaaagaaaaaaaatatttaatggaatctgtgctcaaataatatgttacaacaaaaatatacagaatgtacacaatacaaaaatacttagaaacaaacattgcagtctgtgttttgttttttccacttactcaagtcctcggaggggcagttcactgttgggcactgtttttaaggcagaggagaaccgtgctttccagccagcacggggagcaacatgaatgatgccaggaaaggctttcacggcacccagggaatctgcattacgtatttgcaaattaaattggacgctgggggaagatcctggtgtggtgagcaacagctcccctaatcctctgggcaagaatggttctcatggaaatcgagagtcctattagctggcaaaagagcctcattagggagcttttcctaattaaaaaacgaatgatgaatggtgtcattaaagcgaaatttctcctttgaaggtttgttttcccttccccagtttctgtgattcctctcccgtttaatgagagccagtgagtctatggctgctgtttggggattccccagctttcagtttctgtatcctgtggataaaaggccaacctacctccaccagcctgaagatttacacaccaccccctgggctggcagccacctcagacaaggaaagaggcacagaggacacggccagccttggccatggggaagtgctgctgagagggtggtgggacctgctgaggagaaagccagatgccacaaagagaacccctctgaccagacagctgcctcctgacctggggagaggcctgggtcaggtgaagtgaccctatgaccccaccctgtggccccgcttggaagtcatggttgggagaggggatggaggtgggtgtgctgacagagaacagctggggctggtggtctaaggtgtagacgagggtccttggcagcagaggacacacttaacatggtgggagacacgattccgcctccactgtccttctcagtaacaagcttccctgggagtccccgagggagctgagtgcttctatgagggatttctagaatcttctagttcaatgctttctcacccctaagagaggaagccccctctccaggtcataccagacagaggtggcactctgctcattccacccacaccacagaatccccaggggccaggacaggaatctggaggggattctccatccctccaggaaaggacctcatcgctcagcttagtgcggctgcagcccaggcagaggcagcaatgtcctgactccttctgcatcctcccctggtcttccctgagcccagctccacagcctcagagcctcctcctctgaggcactgacttccatctacatctttctatcactagggcagagaacggtgggcagggcacacacaagacgccccaggctgacgcaacaccgccaaaggcgtgggcccacagtgccacaggctgcggccctcagcatggcactggtgcaggggagcaggacctagggaactacatatgtggatgaggccagggcaatctatttagcagtgggccaagatgcggtatggctgggcctcgcctgccagtgagtgagtgagcccatttacatgtagtcaccaggatgggaagccactgtggcccaagaccccaaatgcctggcctgactgaccctggaccctgctacactcaagggccaggatgggcaccaggctggaggaagaccgttcccacactcctgcccctgtttctggacacgcccagcccccctgcctcctcccaggcctggcgttctttgttcttctgggctgtcagtggttgagaattccaagagcacgataaagggagtgtcatcttttgtcaaaggtcatcctcatgccctccattcggggcctgcaccagctcctgttaggagggtcattccctccatcttgttttctcacctgtgtaatggggtggggtggatttgataaccaccatgttctctcccgcatccaagcctccgaggctactggctgccctccctctgaggttcatccatgcacccaacaattctcctgaggcaaagttttccaactaaactggaattcctcttcctgtagcctcctgtccccctaacttaaatggacacatggcctcaacattcctaccccagcctctcttgcgcccccaaagctctttctctcctaagggagataggatggaacctttttggatatgaaggccatctcagacggaaacaagagctgaacctggcaaacctcagcatccagggatccttggagggcttgagctctccctccagcagggccattctgccaccggtcagtgatgctcaggggcaggtgtggaagggacaggagatgggaaggaagggggcaggctttgtcaaagcaaggacattcagcaaccacagcacaccacggtctgccacctctcacggatgcccacatgggccccctgcatcctccatgccttctctgcaggcgctgtcgtgcctcagttacctttcccatcacatacacacatatacgcacacacacacacacacgcatgaatgtttcaaa

SEQ ID NO: 373471 - DNA, 1512 bp, Homo sapiens
cccggccgctcctaaaagccatcttctcctctcccagccaagattggcacagcaacgaggggacagtgaggacggaagcccaagtggcacaaatgcagaaactccctctggtgatgatttcagaatgtgtgtctttcatttgtcaagcccctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggccatgacagaggagcagcataagtctgtggtcatcgattgcagcagctcccagcctcagttctgcaatgcaggaagtaaccggttttgtgaggattggatgcaagcttttttaaatggtgccaaaggaggtaacccttttcttttccgacaagtactggagaactttaaactaaaggccatacaagacacaaacaatttgaagagatttatccgacaggcagaaatgaatcattatgctttgtttaaatgttacatgttcctaaagaactgtggtagtggagatatacttttgaagattgttaaagtggaacatgaagaaatgcctgaagccaaaaatgtgatagctgtccttgaagaattcatgaaagaagctcttgaccaaagtttttgatcatatgttttgagataattgtatgatcaagttgtatatttaagtcttagtgtttgaaattgcagttataattgttcataggattgctatttaagatgatttgaaactcaatccagattttctttttgtattttaccaatttaacttaaataaaaatctgaagaacatcttcactgagtcctagatagataatgtatgtgagagttgtgaaattttagtgtctcactggccccataaattccacgcttcaggaagttgttgcttaaaaaatttcagagatgattttgtttgtggcttttctcaggaaaagcctgagtttgctgcagtatttagcaacttttcttctcagaaaaaccataatacttccttttcagtggactgtagcttcttaaa

SEQ ID NO: 373472 - DNA, 1677 bp, Homo sapiens
ttctagttcaactcagaccgtgaagttagcatacaggtcctcaggagtttgaggccacttcccaaggataaggccaccttcaggcacatctgccttaaacatcaatttgtgaagctttgggagaggggagaacatacttttttttaatataaacatgggtatgaactagagtgaaatttgtgtgaatttttcacataagacaggagaattcaaagaaatttcatgtatgttagtggctgctttaactaaagccctccagggtatacattcatttttctttgctgctgcaagtacaccaacgagaagtctgggaagctctgagttagtgggcagtttaatggtgttgccagatcaagatgaccagaattcagagcagtccacaaaattatagatgcatgagtaaccaaaataatgcattttacattttctttcttttctagaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggccatgacagaggagcagcataagtctgtggtcatcgattgcagcagctcccagcctcagttctgcaatgcaggaagtaaccggttttgtgaggattggatgcaagcttttttaaatggtgccaaaggaggtaacccttttcttttccgacaagtactggagaactttaaactaaaggccatacaagacacaaacaatttgaagagatttatccgacaggcagaaatgaatcattatgctttgtttaaatgttacatgttcctaaagaactgtggtagtggagatatacttttgaagattgttaaagtggaacatgaagaaatgcctgaagccaaaaatgtgatagctgtccttgaagaattcatgaaagaagctcttgaccaaagtttttgatcatatgttttgagataattgtatgatcaagttgtatatttaagtcttagtgtttgaaattgcagttataattgttcataggattgctatttaagatgatttgaaactcaatccagattttctttttgtattttaccaatttaacttaaataaaaatctgaagaacatcttcactgagtcctagatagataatgtatgtgagagttgtgaaattttagtgtctcactggccccataaattccacgcttcaggaagttgttgcttaaaaaatttcagagatgattttgtttgtggcttttctcaggaaaagcctgagtttgctgcagtatttagcaacttttcttctcagaaaaaccataatacttccttttcagtggactgtagcttcttaaa

SEQ ID NO: 373473 - DNA, 725 bp, Homo sapiens
gagcggtttggcggagacacagggccgctcagaggccgccgcaatgctcccctctttgcaggagtcgatggatggagatgaaaaggaactagagagcagcgaagagggaggctcagccgaggagcggagactcgagccgccgtccagcagccactactgtctttacagctatcgcggaagcagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggaggggcccgccccccgccccccgcccccccctcccctcccgcccccgccaacatcaggaaggaaaacatgggaaggcaggtggaagaatattactaccaacctccaaaaagcttttctactcctcgtgtatttagttgaatttcataccttcatgtggccattttgccttggcttgtttgcatttgcagctcacattatttgagagattttatat

SEQ ID NO: 373474 - DNA, 1401 bp, Homo sapiens
gagcggtttggcggagacacagggccgctcagaggccgccgcaatgctcccctctttgcaggagtcgatggatggagatgaaaaggaactagagagcagcgaagagggaggctcagccgaggagcggagactcgagccgccgtccagcagccactactgtctttacagctatcgcggaagcagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggccatgacagaggagcagcataagtctgtggtcatcgattgcagcagctcccagcctcagttctgcaatgcaggaagtaaccggttttgtgaggattggatgcaagcttttttaaatggtgccaaaggaggtaacccttttcttttccgacaagtactggagaactttaaactaaaggccatacaagacacaaacaatttgaagagatttatccgacaggcagaaatgaatcattatgctttgtttaaatgttacatgttcctaaagaactgtggtagtggagatatacttttgaagattgttaaagtggaacatgaagaaatgcctgaagccaaaaatgtgatagctgtccttgaagaattcatgaaagaagctcttgaccaaagtttttgatcatatgttttgagataattgtatgatcaagttgtatatttaagtcttagtgtttgaaattgcagttataattgttcataggattgctatttaagatgatttgaaactcaatccagattttctttttgtattttaccaatttaacttaaataaaaatctgaagaaca

SEQ ID NO: 373475 - DNA, 1692 bp, Homo sapiens
gcgacccataactgtgttctaccggcaaagtaaaagggaggagaaaagaagcaggagaaacgaggccaaaaatccctcactttcccaacccaacggctaccaccacgtcccacaggaagcagacacaaaatggccgacggcctcgttccccgctccgcctcccgtcaagcactgcggtaggagcggagccaagaaggggagggtcacatgacgcagacctccgccctgagtgggtgggactaagaggcgcgaagaggtggcagccatcttgtccgtttcagagtttttcgctttcgctggctgtgcttgcggagcactttgggtttcatttgtaaaggagccggagccccaggagtcgatggatggagatgaaaaggaactagagagcagcgaagagggaggctcagccgaggagcggagactcgagccgccgtccagcagccactactgtctttacagctatcgcggaagcagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggccatgacagaggagcagcataagtctgtggtcatcgattgcagcagctcccagcctcagttctgcaatgcaggaagtaaccggttttgtgaggattggatgcaagcttttttaaatggtgccaaaggaggtaacccttttcttttccgacaagtactggagaactttaaactaaaggccatacaagacacaaacaatttgaagagatttatccgacaggcagaaatgaatcattatgctttgtttaaatgttacatgttcctaaagaactgtggtagtggagatatacttttgaagattgttaaagtggaacatgaagaaatgcctgaagccaaaaatgtgatagctgtccttgaagaattcatgaaagaagctcttgaccaaagtttttgatcatatgttttgagataattgtatgatcaagttgtatatttaagtcttagtgtttgaaattgcagttataattgttcataggattgctatttaagatgatttgaaactcaatccagattttctttttgtattttaccaatttaacttaaataaaaatctgaagaaca

SEQ ID NO: 373476 - DNA, 1627 bp, Homo sapiens
gagcggtttggcggagacacagggccgctcagaggccgccgcaatgctcccctctttgcaggagtcgatggatggagatgaaaaggaactagagagcagcgaagagggaggctcagccgaggagcggagactcgagccgccgtccagcagccactactgtctttacagctatcgcggaagcagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggccatgacagaggagcagcataagtctgtggtcatcgattgcagcagctcccagcctcagttctgcaatgcaggaagtaaccggttttgtgaggattggatgcaagcttttttaaatggtgccaaaggaggtaacccttttcttttccgacaagtactggagaactttaaactaaaggccatacaagacacaaacaatttgaagagatttatccgacaggcagaaatgaatcattatgctttgtttaaatgttacatgttcctaaagaactgtggtagtggagatatacttttgaagattgttaaagtggaacatgaagaaatgcctgaagccaaaaatgtgatagctgtccttgaagaattcatgaaagaagctcttgaccaaagtttttgatcatatgttttgagataattgtatgatcaagttgtatatttaagtcttagtgtttgaaattgcagttataattgttcataggattgctatttaagatgatttgaaactcaatccagattttctttttgtattttaccaatttaacttaaataaaaatctgaagaacatcttcactgagtcctagatagataatgtatgtgagagttgtgaaattttagtgtctcactggccccataaattccacgcttcaggaagttgttgcttaaaaaatttcagagatgattttgtttgtggcttttctcaggaaaagcctgagtttgctgcagtatttagcaacttttcttctcagaaaaaccataatacttccttttcagtggactgtagcttcttaaa

SEQ ID NO: 373477 - DNA, 1486 bp, Homo sapiens
cccggccgctcctaaaagccatcttctcctctcccagccaagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggccatgacagaggagcagcataagtctgtggtcatcgattgcagcagctcccagcctcagttctgcaatgcaggaagtaaccggttttgtgaggattggatgcaagcttttttaaatggtgccaaaggaggtaacccttttcttttccgacaagtactggagaactttaaactaaaggccatacaagacacaaacaatttgaagagatttatccgacaggcagaaatgaatcattatgctttgtttaaatgttacatgttcctaaagaactgtggtagtggagatatacttttgaagattgttaaagtggaacatgaagaaatgcctgaagccaaaaatgtgatagctgtccttgaagaattcatgaaagaagctcttgaccaaagtttttgatcatatgttttgagataattgtatgatcaagttgtatatttaagtcttagtgtttgaaattgcagttataattgttcataggattgctatttaagatgatttgaaactcaatccagattttctttttgtattttaccaatttaacttaaataaaaatctgaagaacatcttcactgagtcctagatagataatgtatgtgagagttgtgaaattttagtgtctcactggccccataaattccacgcttcaggaagttgttgcttaaaaaatttcagagatgattttgtttgtggcttttctcaggaaaagcctgagtttgctgcagtatttagcaacttttcttctcagaaaaaccataatacttccttttcagtggactgtagcttcttaaa

SEQ ID NO: 373478 - DNA, 1219 bp, Homo sapiens
agcggagggctgatctccgtctccgcccccagctgctttctccttcaggaaaaatctgtaatggggggcgggcccggagggctgtcggtgggcccgtctgcgtacgacggcccgtcccctgcgcacggacgccgggaagaagggggtggggccacgtttgcgtccgcgccatcaggcccgagatagcggcgaggtccgctttcagtgtatggttttccctgccaaacggttctgcttggtgccatccatggagggcgtgcgctgggccttttcctgcggcacttggctgccgagccgagccgaatggctgctggcagtgcgatcgattcagcccgaggagaaggagcgcattggccagttcgtctttgcccgggacgctaaggcagccatggctggtcgtctgatgataaggaaattagttgcagagaaattgaatatcccttggaatcatattcgtttgcaaagaactgcaaaaggaaaaccagttcttgcaaaggactcatcgaatccttacccgaatttcaactttaacatctctcatcaaggagactatgcagtgcttgctgctgaacctgagctgcaagttggaattgatataatgaagactagttttccaggtcgtggttcaattccagaattctttcatattatgaaaagaaagtttaccaacaaagaatgggaaacaatcagaagctttaaggatgagtggactcagctggatatgttttataggaattgggcacttaaggaaagcttcataaaagccattggtgttggactaggatttgaattgcagcggcttgaatttgatctatctccattaaacttggatataggccaagtttataaagaaacacgtttattcctggatggagaggaagaaaaagaatgggcatttgaggaaagcaaaatagatgagcaccattttgttgcagttgctcttaggaaacccgatggatctagacatcaggatgttccatctcaggatgattccaaaccaacccagaggcaatttactattctcaactttaatgatttaatgtcatctgccgttcccatgacacctgaagatccttcattttgggactgtttttgcttcacagaagaaattccaatacgaaatggtacaaagtcatgatgattccctgagtaacaaagggaaatgaaaactgtttgtgatcttccgtattcactgaaaaataaatgcttgtttagtatc

SEQ ID NO: 373479 - DNA, 1193 bp, Homo sapiens
cctgaaatcacagatagtactgaaccctatatatactgtgttttttgctatacgtacatacctatgataaagtttaatttataaatttgacatattaagagattaacaaccatgctactaataaaatagaacagttataacaatatccttttatcacataataaaagttaagtgaatgtagtctctttcaaaaatatcttattgtactattctcacctattgttggaccatggttcactgcaggtaactgaaactacggaaagcaagactccaactcaaaaaaaaaaaaaagaccacattgaaaagcataagaaacaaggaataccaagagaaaattgtatcactgaagctaaaagaggattttgagaaggaggaagtcataatttactcacttttttctgtgttagacattttgattatctgcagtttattactacaagcagtggcagagtgaatgtccttgtacattttgagttacatgcttaattatgtccttgagaaagtttctaaaagtggaatgattggtttgactggttcatagggctttaattatacaatttacccctctaattagtactatatgtatgtgacttccctccccctgccagaatactccttggtcaattgtaggtattctttttggtttaatttttgccaatgtaattaaaaaatggtatgtcatttttaaaatttgtatttctttcattacaaataagattgttatgtcagtattgttattggcttttcgtattcctcttaacgtgaaccgtctgttcattgtttttacctgttttcgttttagcaagtagtacttaatttaaagtgtgaacttaatatataagatgccaggaccatcatattgatgacaaaaatctattatgtggttgtagtgcatgtcttggagttaaactcttaagtatcaagaagtaaaataatttcattgtttctgttactaacattaaaagtgtgcaaattgtataaaattaggtacttcgattagtaaaagaaaaaaatttgaatgttttttttttttattttattaagcatgcccagttatgccaagcatagtaaataaaggtcaagtagcatttataatagaggaagtattgttatccctagcatgagtgtaatggtgatatgaaaaactttgtcttgtcattataataataaaaaaatgaacatttattatggaa

SEQ ID NO: 373480 - DNA, 688 bp, Homo sapiens
ctatttcatttttttttgatttgttgtattggcaacactaatataagaaatacaaacaatgttctaggaatcctatgttgtcatttaatactactgaaatgtaagttggtcttacttattttcatgattatgaaattgatcataagattaacatgcaatataacaataaggtaatctgcttttgtcttttaggttccatctcaggatgattccaaaccaacccagaggcaatttactattctcaactttaatgatttaatgtcatctgccgttcccatgacacctgaagatccttcattttgggactgtttttgcttcacagaagaaattccaatacgaaatggtacaaagtcatgatgattcccttcctgccctgcagtggcttggaaatagctgtgttcctcagcatcacagcttctgacatagccttctccatatatacatctcatgggttcaggaacaacttttccctgccttttcattttagaagtagaaagatcttgctcttgcttagcctaagctgctgcaccatctccatagatttttgttattcttgcctacaccctctttgatcattacttttggttgtgccatctgtttcctgctacaaccctgactaatacagtaatttgtaccatgagtagtcctgggaaagtggaattctggaattggattgctcacatatttg

SEQ ID NO: 373481 - DNA, 3222 bp, Homo sapiens
  misc_feature (2928)..(2928): n is a, c, g, or t
  misc_feature (2935)..(2936): n is a, c, g, or t
agcggagggctgatctccgtctccgcccccagctgctttctccttcaggaaaaatctgtaatggggggcgggcccggagggctgtcggtgggcccgtctgcgtacgacggcccgtcccctgcgcacggacgccgggaagaagggggtggggccacgtttgcgtccgcgccatcaggcccgagatagcggcgaggtccgctttcagtgtatggttttccctgccaaacggttctgcttggtgccatccatggagggcgtgcgctgggccttttcctgcggcacttggctgccgagccgagccgaatggctgctggcagtgcgatcgattcagcccgaggagaaggagcgcattggccagttcgtctttgcccgggacgctaaggcagccatggctggtcgtctgatgataaggaaattagttgcagagaaattgaatatcccttggaatcatattcgtttgcaaagaactgcaaaaggaaaaccagttcttgcaaaggactcatcgaatccttacccgaatttcaactttaacatctctcatcaaggagactatgcagtgcttgctgctgaacctgagctgcaagttggaattgatataatgaagactagttttccaggtcgtggttcaattccagaattctttcatattatgaaaagaaagtttaccaacaaagaatgggaaacaatcagaagctttaaggatgagtggactcagctggatatgttttataggaattgggcacttaaggaaagcttcataaaagccattggtgttggactaggatttgaattgcagcggcttgaatttgatctatctccattaaacttggatataggccaagtttataaagaaacacgtttattcctggatggagaggaagaaaaagaatgggcatttgaggaaagcaaaatagatgagcaccattttgttgcagttgctcttaggaaacccgatggatctagacatcaggatgttccatctcaggatgattccaaaccaacccagaggcaatttactattctcaactttaatgatttaatgtcatctgccgttcccatgacacctgaagatccttcattttgggactgtttttgcttcacagaagaaattccaatacgaaatggtacaaagtcatgatgattccctgagtaacaaagggaaatgaaaactgtttgtgatcttccgtattcactgaaaaataaatgcttgtttagtatcaaattttatttcacgaaagtttttttaaagaacagaaacttttccaattaaaaaaaaaaagcagacttctggttcaagatagctcactggaatacatgtttacctctttctttcctaaattgcattgaattgataggaaggatggcggaatcttaaagtgatacatgctaactgtagaaaaaaatagaaaatgcacataagcaaaaggaaacatttaaatgctatctttcaaagataactactcttaaaaccttgagtatcttttcagacctttttcttggcaaatgaatccatattgacatatttgatttttttaaaaacatggaaacgtactgttttgtaaattctttttaactgcacatctactgttcataaatatacctctgtaacataactttttgtggttctaatgtactctgttgtatagctaatacaagttaggatgcttttggccagaggtaacagtgtccaaatataattggcctaagtaacctaggaaattgtttgacataacacagggttcaggggtgtcattaaagacacactttttttgccttgacctcagttggtttgttttgccttaggctattccacctctcgatcacaagagctgctgctataacttccagttttacatctttgtaaaattgtatctcaaaggcagaaaaggccatttcgtctctcatttgttttatccatgaggaagatttttaacaaaagcctccagaagatttcccctcagtttccattgacttagatcaggttacagagaaaggcaatgtctgacatttttggtctctgttagaagtagactctgttgaaaagaaagaagctaagctaggtgtgaagaatggaattggaagcccactgccttcccataagaaaggtttaccataatttactcacttttttctgtgttagacattttgattatctgcagtttattactacaagcagtggcagagtgaatgtccttgtacattttgagttacatgcttaattatgtccttgagaaagtttctaaaagtggaatgattggtttgactggttcatagggctttaattatacaatttacccctctaattagtactatatgtatgtgacttccctccccctgccagaatactccttggtcaattgtaggtattctttttggtttaatttttgccaatgtaattaaaaaatggtatgtcatttttaaaatttgtatttctttcattacaaataagattgttatgtcagtattgttattggcttttcgtattcctcttaacgtgaaccgtctgttcattgtttttacctgttttcgttttagcaagtagtacttaatttaaagtgtgaacttaatatataagatgccaggaccatcatattgatgacaaaaatctattatgtggttgtagtgcatgtcttggagttaaactcttaagtatcaagaagtaaaataatttcattgtttctgttactaacattaaaagtgtgcaaattgtataaaattaggtacttcgattagtaaaagaaaaaaatttgaatgttttttttttttattttattaagcatgcccagttatgccaagcatagtaaataaaggtcaagtagcatttataatagaggaagtattgttatccctagcatgagtgtaatggtgatatgaaaaactttgtcttgtcattataataataaaaaaatgaacatttattatggaaanaaacacnnacaaagacaccgacagaacccaccagacaaaagagacaaaacacaacagcgaaccaccaaagaggcgcaacaaacaaacacagcaaaaaagaaaaagaaaagtagaacagggaggcgaagacaaaacacgcaagaaagaaaacacaagaggcggggccgggcgccccgcacgaaaatagagcatcaaaacaaccgttgacaggggcgcgcgcgaccaaagatagcagcaagactcgtctcaagaacaacgagcgaggaaggaagagaggggaacacacaacaaagg

SEQ ID NO: 373482 - DNA, 764 bp, Homo sapiens
  misc_feature (701)..(702): n is a, c, g, or t
  misc_feature (717)..(717): n is a, c, g, or t
agcggagggctgatctccgtctccgcccccagctgctttctccttcaggaaaaatctgtaatggggggcgggcccggagggctgtcggtgggcccgtctgcgtacgacggcccgtcccctgcgcacggacgccgggaagaagggggtggggccacgtttgcgtccgcgccatcaggcccgagatagcggcgaggtccgctttcagtgtatggttttccctgccaaacggttctgcttggtgccatccatggagggcgtgcgctgggccttttcctgcggcacttggctgccgagccgagccgaatggctgctggcagtgcgatcgattcagcccgaggagaaggagcgcattggccagttcgtctttgcccgggacgctaaggcagccatggctggtcgtctgatgataaggaaattagttgcagagaaattgaatatcccttggaatcatattcgtttgcaaagaactgcaaaaggaaaaccagttcttgcaaaggactcatcgaatccttacccgaatttcaactttaacatctctcatcaaggagactatgcagtgcttgctgctgaacctgagctgcaagttggaattgatataatgaagactagttttccagcgtggttcaattccagaattctttcatattaatgaagaagttacacaagatggacatcagagcttaggatgagtgctcagctgnngttaagatggcctangaagctcataagcatgtgtgactagattgaatgcgcgctgactgtct

SEQ ID NO: 373483 - DNA, 2926 bp, Homo sapiens
agcggagggctgatctccgtctccgcccccagctgctttctccttcaggaaaaatctgtaatggggggcgggcccggagggctgtcggtgggcccgtctgcgtacgacggcccgtcccctgcgcacggacgccgggaagaagggggtggggccacgtttgcgtccgcgccatcaggcccgagatagcggcgaggtccgctttcagtgtatggttttccctgccaaacggttctgcttggtgccatccatggagggcgtgcgctgggccttttcctgcggcacttggctgccgagccgagccgaatggctgctggcagtgcgatcgattcagcccgaggagaaggagcgcattggccagttcgtctttgcccgggacgctaaggcagccatggctggtcgtctgatgataaggaaattagttgcagagaaattgaatatcccttggaatcatattcgtttgcaaagaactgcaaaaggaaaaccagttcttgcaaaggactcatcgaatccttacccgaatttcaactttaacatctctcatcaaggagactatgcagtgcttgctgctgaacctgagctgcaagttggaattgatataatgaagactagttttccaggtcgtggttcaattccagaattctttcatattatgaaaagaaagtttaccaacaaagaatgggaaacaatcagaagctttaaggatgagtggactcagctggatatgttttataggaattgggcacttaaggaaagcttcataaaagccattggtgttggactaggatttgaattgcagcggcttgaatttgatctatctccattaaacttggatataggccaagtttataaagaaacacgtttattcctggatggagaggaagaaaaagaatgggcatttgaggaaagcaaaatagatgagcaccattttgttgcagttgctcttaggaaacccgatggatctagacatcaggatgttccatctcaggatgattccaaaccaacccagaggcaatttactattctcaactttaatgatttaatgtcatctgccgttcccatgacacctgaagatccttcattttgggactgtttttgcttcacagaagaaattccaatacgaaatggtacaaagtcatgatgattccctgagtaacaaagggaaatgaaaactgtttgtgatcttccgtattcactgaaaaataaatgcttgtttagtatcaaattttatttcacgaaagtttttttaaagaacagaaacttttccaattaaaaaaaaaaagcagacttctggttcaagatagctcactggaatacatgtttacctctttctttcctaaattgcattgaattgataggaaggatggcggaatcttaaagtgatacatgctaactgtagaaaaaaatagaaaatgcacataagcaaaaggaaacatttaaatgctatctttcaaagataactactcttaaaaccttgagtatcttttcagacctttttcttggcaaatgaatccatattgacatatttgatttttttaaaaacatggaaacgtactgttttgtaaattctttttaactgcacatctactgttcataaatatacctctgtaacataactttttgtggttctaatgtactctgttgtatagctaatacaagttaggatgcttttggccagaggtaacagtgtccaaatataattggcctaagtaacctaggaaattgtttgacataacacagggttcaggggtgtcattaaagacacactttttttgccttgacctcagttggtttgttttgccttaggctattccacctctcgatcacaagagctgctgctataacttccagttttacatctttgtaaaattgtatctcaaaggcagaaaaggccatttcgtctctcatttgttttatccatgaggaagatttttaacaaaagcctccagaagatttcccctcagtttccattgacttagatcaggttacagagaaaggcaatgtctgacatttttggtctctgttagaagtagactctgttgaaaagaaagaagctaagctaggtgtgaagaatggaattggaagcccactgccttcccataagaaaggtttaccataatttactcacttttttctgtgttagacattttgattatctgcagtttattactacaagcagtggcagagtgaatgtccttgtacattttgagttacatgcttaattatgtccttgagaaagtttctaaaagtggaatgattggtttgactggttcatagggctttaattatacaatttacccctctaattagtactatatgtatgtgacttccctccccctgccagaatactccttggtcaattgtaggtattctttttggtttaatttttgccaatgtaattaaaaaatggtatgtcatttttaaaatttgtatttctttcattacaaataagattgttatgtcagtattgttattggcttttcgtattcctcttaacgtgaaccgtctgttcattgtttttacctgttttcgttttagcaagtagtacttaatttaaagtgtgaacttaatatataagatgccaggaccatcatattgatgacaaaaatctattatgtggttgtagtgcatgtcttggagttaaactcttaagtatcaagaagtaaaataatttcattgtttctgttactaacattaaaagtgtgcaaattgtataaaattaggtacttcgattagtaaaagaaaaaaatttgaatgttttttttttttattttattaagcatgcccagttatgccaagcatagtaaataaaggtcaagtagcatttataatagaggaagtattgttatccctagcatgagtgtaatggtgatatgaaaaactttgtcttgtcattataataataaaaaaatgaacatttattatggaa

SEQ ID NO: 373484 - DNA, 2950 bp, Homo sapiens
agcggagggctgatctccgtctccgcccccagctgctttctccttcaggaaaaatctgtaatggggggcgggcccggagggctgtcggtgggcccgtctgcgtacgacggcccgtcccctgcgcacggacgccgggaagaagggggtggggccacgtttgcgtccgcgccatcaggcccgagatagcggcgaggtccgctttcagtgtatggttttccctgccaaacggttctgcttggtgccatccatggagggcgtgcgctgggccttttcctgcggcacttggctgccgagccgagccgaatggctgctggcagtgcgatcgattcagcccgaggagaaggagcgcattggccagttcgtctttgcccgggacgctaaggcagccatggctggtcgtctgatgataaggaaattagttgcagagaaattgaatatcccttggaatcatattcgtttgcaaagaactgcaaaaggaaaaccagttcttgcaaaggactcatcgaatccttacccgaatttcaactttaacatctctcatcaaggagactatgcagtgcttgctgctgaacctgagctgcaagttggaattgatataatgaagactagttttccaggtcgtggttcaattccagaattctttcatattatgaaaagaaagtttaccaacaaagaatgggaaacaatcagaagctttaaggatgagtggactcagctggatatgttttataggaattgggcacttaaggaaagcttcataaaagccattggtgttggactaggatttgaattgcagcggcttgaatttgatctatctccattaaacttggatataggccaagtttataaagaaacacgtttattcctggatggagaggaagaaaaagaatgggcatttgaggaaagcaaaatagatgagcaccattttgttgcagttgctcttaggaaacccgatggatctagacatcaggatgttccatctcaggatgattccaaaccaacccagaggcaatttactattctcaactttaatgatttaatgtcatctgccgttcccatgacacctgaagatccttcattttgggactgtttttgcttcacagaagaaattccaatacgaaatggtacaaagtcatgatgattccctgagtaacaaagggaaatgaaaactgtttgtgatcttccgtattcactgaaaaataaatgcttgtttagtatcaaattttatttcacgaaagtttttttaaagaacagaaacttttccaattaaaaaaaaaaagcagacttctggttcaagatagctcactggaatacatgtttacctctttctttcctaaattgcattgaattgataggaaggatggcggaatcttaaagtgatacatgctaactgtagaaaaaaatagaaaatgcacataagcaaaaggaaacatttaaatgctatctttcaaagataactactcttaaaaccttgagtatcttttcagacctttttcttggcaaatgaatccatattgacatatttgatttttttaaaaacatggaaacgtactgttttgtaaattctttttaactgcacatctactgttcataaatatacctctgtaacataactttttgtggttctaatgtactctgttgtatagctaatacaagttaggatgcttttggccagaggtaacagtgtccaaatataattggcctaagtaacctaggaaattgtttgacataacacagggttcaggggtgtcattaaagacacactttttttgccttgacctcagttggtttgttttgccttaggctattccacctctcgatcacaagagctgctgctataacttccagttttacatctttgtaaaattgtatctcaaaggcagaaaaggccatttcgtctctcatttgttttatccatgaggaagatttttaacaaaagcctccagaagatttcccctcagtttccattgacttagatcaggttacagagaaaggcaatgtctgacatttttggtctctgttagaagtagactctgttgaaaagaaagaagctaagctaggtgtgaagaatggaattggaagcccactgccttcccataagaaaggtttaccataatttactcacttttttctgtgttagacattttgattatctgcagtttattactacaagcagtggcagagtgaatgtccttgtacattttgagttacatgcttaattatgtccttgagaaagtttctaaaagtggaatgattggtttgactggttcatagggctttaattatacaatttacccctctaattagtactatatgtatgtgacttccctccccctgccagaatactccttggtcaattgtaggtattctttttggtttaatttttgccaatgtaattaaaaaatggtatgtcatttttaaaatttgtatttctttcattacaaataagattgttatgtcagtattgttattggcttttcgtattcctcttaacgtgaaccgtctgttcattgtttttacctgttttcgttttagcaagtagtacttaatttaaagtgtgaacttaatatataagatgccaggaccatcatattgatgacaaaaatctattatgtggttgtagtgcatgtcttggagttaaactcttaagtatcaagaagtaaaataatttcattgtttctgttactaacattaaaagtgtgcaaattgtataaaattaggtacttcgattagtaaaagaaaaaaatttgaatgttttttttttttattttattaagcatgcccagttatgccaagcatagtaaataaaggtcaagtagcatttataatagaggaagtattgttatccctagcatgagtgtaatggtgatatgaaaaactttgtcttgtcattataataataaaaaaatgaacatttattatggaatttctatgagcctgaaaaaaagtt

SEQ ID NO: 373485 - DNA, 2872 bp, Homo sapiens
agcggagggctgatctccgtctccgcccccagctgctttctccttcaggaaaaatctgtaatggggggcgggcccggagggctgtcggtgggcccgtctgcgtacgacggcccgtcccctgcgcacggacgccgggaagaagggggtggggccacgtttgcgtccgcgccatcaggcccgagatagcggcgaggtccgctttcagtgtatggttttccctgccaaacggttctgcttggtgccatccatggagggcgtgcgctgggccttttcctgcggcacttggctgccgagccgagccgaatggctgctggcagtgcgatcgattcagcccgaggagaaggagcgcattggccagttcgtctttgcccgggacgctaaggcagccatggctggtcgtctgatgataaggaaattagttgcagagaaattgaatatcccttggaatcatattcgtttgcaaagaactgcaaaaggaatctctcatcaaggagactatgcagtgcttgctgctgaacctgagctgcaagttggaattgatataatgaagactagttttccaggtcgtggttcaattccagaattctttcatattatgaaaagaaagtttaccaacaaagaatgggaaacaatcagaagctttaaggatgagtggactcagctggatatgttttataggaattgggcacttaaggaaagcttcataaaagccattggtgttggactaggatttgaattgcagcggcttgaatttgatctatctccattaaacttggatataggccaagtttataaagaaacacgtttattcctggatggagaggaagaaaaagaatgggcatttgaggaaagcaaaatagatgagcaccattttgttgcagttgctcttaggaaacccgatggatctagacatcaggatgttccatctcaggatgattccaaaccaacccagaggcaatttactattctcaactttaatgatttaatgtcatctgccgttcccatgacacctgaagatccttcattttgggactgtttttgcttcacagaagaaattccaatacgaaatggtacaaagtcatgatgattccctgagtaacaaagggaaatgaaaactgtttgtgatcttccgtattcactgaaaaataaatgcttgtttagtatcaaattttatttcacgaaagtttttttaaagaacagaaacttttccaattaaaaaaaaaaagcagacttctggttcaagatagctcactggaatacatgtttacctctttctttcctaaattgcattgaattgataggaaggatggcggaatcttaaagtgatacatgctaactgtagaaaaaaatagaaaatgcacataagcaaaaggaaacatttaaatgctatctttcaaagataactactcttaaaaccttgagtatcttttcagacctttttcttggcaaatgaatccatattgacatatttgatttttttaaaaacatggaaacgtactgttttgtaaattctttttaactgcacatctactgttcataaatatacctctgtaacataactttttgtggttctaatgtactctgttgtatagctaatacaagttaggatgcttttggccagaggtaacagtgtccaaatataattggcctaagtaacctaggaaattgtttgacataacacagggttcaggggtgtcattaaagacacactttttttgccttgacctcagttggtttgttttgccttaggctattccacctctcgatcacaagagctgctgctataacttccagttttacatctttgtaaaattgtatctcaaaggcagaaaaggccatttcgtctctcatttgttttatccatgaggaagatttttaacaaaagcctccagaagatttcccctcagtttccattgacttagatcaggttacagagaaaggcaatgtctgacatttttggtctctgttagaagtagactctgttgaaaagaaagaagctaagctaggtgtgaagaatggaattggaagcccactgccttcccataagaaaggtttaccataatttactcacttttttctgtgttagacattttgattatctgcagtttattactacaagcagtggcagagtgaatgtccttgtacattttgagttacatgcttaattatgtccttgagaaagtttctaaaagtggaatgattggtttgactggttcatagggctttaattatacaatttacccctctaattagtactatatgtatgtgacttccctccccctgccagaatactccttggtcaattgtaggtattctttttggtttaatttttgccaatgtaattaaaaaatggtatgtcatttttaaaatttgtatttctttcattacaaataagattgttatgtcagtattgttattggcttttcgtattcctcttaacgtgaaccgtctgttcattgtttttacctgttttcgttttagcaagtagtacttaatttaaagtgtgaacttaatatataagatgccaggaccatcatattgatgacaaaaatctattatgtggttgtagtgcatgtcttggagttaaactcttaagtatcaagaagtaaaataatttcattgtttctgttactaacattaaaagtgtgcaaattgtataaaattaggtacttcgattagtaaaagaaaaaaatttgaatgttttttttttttattttattaagcatgcccagttatgccaagcatagtaaataaaggtcaagtagcatttataatagaggaagtattgttatccctagcatgagtgtaatggtgatatgaaaaactttgtcttgtcattataataataaaaaaatgaacatttattatggaa

SEQ ID NO: 373486 - DNA, 2804 bp, Homo sapiens
agcggagggctgatctccgtctccgcccccagctgctttctccttcaggaaaaatctgtaatggggggcgggcccggagggctgtcggtgggcccgtctgcgtacgacggcccgtcccctgcgcacggacgccgggaagaagggggtggggccacgtttgcgtccgcgccatcaggcccgagatagcggcgaggtccgctttcagtgtatggttttccctgccaaacggttctgcttggtgccatccatggagggcgtgcgctgggccttttcctgcggcacttggctgccgagccgagccgaatggctgctggcagtgcgatcgattcagcccgaggagaaggagcgcattggccagttcgtctttgcccgggacgctaaggcagccatggctggtcgtctgatgataaggaaattagttgcagagaaattgaatatcccttggaatcatattcgtttgcaaagaactgcaaaaggaaaaccagttcttgcaaaggactcatcgaatccttacccgaatttcaactttaacatctctcatcaaggagactatgcagtgcttgctgctgaacctgagctgcaagttggaattgatataatgaagactagttttccaggcacttaaggaaagcttcataaaagccattggtgttggactaggatttgaattgcagcggcttgaatttgatctatctccattaaacttggatataggccaagtttataaagaaacacgtttattcctggatggagaggaagaaaaagaatgggcatttgaggaaagcaaaatagatgagcaccattttgttgcagttgctcttaggaaacccgatggatctagacatcaggatgttccatctcaggatgattccaaaccaacccagaggcaatttactattctcaactttaatgatttaatgtcatctgccgttcccatgacacctgaagatccttcattttgggactgtttttgcttcacagaagaaattccaatacgaaatggtacaaagtcatgatgattccctgagtaacaaagggaaatgaaaactgtttgtgatcttccgtattcactgaaaaataaatgcttgtttagtatcaaattttatttcacgaaagtttttttaaagaacagaaacttttccaattaaaaaaaaaaagcagacttctggttcaagatagctcactggaatacatgtttacctctttctttcctaaattgcattgaattgataggaaggatggcggaatcttaaagtgatacatgctaactgtagaaaaaaatagaaaatgcacataagcaaaaggaaacatttaaatgctatctttcaaagataactactcttaaaaccttgagtatcttttcagacctttttcttggcaaatgaatccatattgacatatttgatttttttaaaaacatggaaacgtactgttttgtaaattctttttaactgcacatctactgttcataaatatacctctgtaacataactttttgtggttctaatgtactctgttgtatagctaatacaagttaggatgcttttggccagaggtaacagtgtccaaatataattggcctaagtaacctaggaaattgtttgacataacacagggttcaggggtgtcattaaagacacactttttttgccttgacctcagttggtttgttttgccttaggctattccacctctcgatcacaagagctgctgctataacttccagttttacatctttgtaaaattgtatctcaaaggcagaaaaggccatttcgtctctcatttgttttatccatgaggaagatttttaacaaaagcctccagaagatttcccctcagtttccattgacttagatcaggttacagagaaaggcaatgtctgacatttttggtctctgttagaagtagactctgttgaaaagaaagaagctaagctaggtgtgaagaatggaattggaagcccactgccttcccataagaaaggtttaccataatttactcacttttttctgtgttagacattttgattatctgcagtttattactacaagcagtggcagagtgaatgtccttgtacattttgagttacatgcttaattatgtccttgagaaagtttctaaaagtggaatgattggtttgactggttcatagggctttaattatacaatttacccctctaattagtactatatgtatgtgacttccctccccctgccagaatactccttggtcaattgtaggtattctttttggtttaatttttgccaatgtaattaaaaaatggtatgtcatttttaaaatttgtatttctttcattacaaataagattgttatgtcagtattgttattggcttttcgtattcctcttaacgtgaaccgtctgttcattgtttttacctgttttcgttttagcaagtagtacttaatttaaagtgtgaacttaatatataagatgccaggaccatcatattgatgacaaaaatctattatgtggttgtagtgcatgtcttggagttaaactcttaagtatcaagaagtaaaataatttcattgtttctgttactaacattaaaagtgtgcaaattgtataaaattaggtacttcgattagtaaaagaaaaaaatttgaatgttttttttttttattttattaagcatgcccagttatgccaagcatagtaaataaaggtcaagtagcatttataatagaggaagtattgttatccctagcatgagtgtaatggtgatatgaaaaactttgtcttgtcattataataataaaaaaatgaacatttattatggaa

SEQ ID NO: 373487 - DNA, 413 bp, Homo sapiens
tcccagcactttgggaggccgaggcgggcagatcacgaggtcaggagatcgagaccatcctggctaacacggtgaaaccctgtctctactaaaaatacaaaaaattagccaggtgtggtggcaggcacctgtagtcccagctactcgggaggctgaggcaggagaattgcttgaacccaggaggcggaggttgcagtgagccgagatcacgccactacactctagcctgggcgacagagcgagactccatctcaaaaaaaaaaaaaagagaaaacgttgaatgatagttcccttaaaataggtgtatccatctcctcaatgcatctccttcttcaacagtaataatctttcttttcctcttttttatttttcaatcttttttagagacagggtctcactttgttgcccaggct

SEQ ID NO: 373488 - DNA, 914 bp, Homo sapiens
  misc_feature (2)..(2): n is a, c, g, or t
  misc_feature (4)..(4): n is a, c, g, or t
gngnttttttttttttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaatctaaa

SEQ ID NO: 373489 - DNA, 1038 bp, Homo sapiens
  misc_feature (2)..(2): n is a, c, g, or t
  misc_feature (4)..(4): n is a, c, g, or t
  misc_feature (925)..(926): n is a, c, g, or t
  misc_feature (929)..(929): n is a, c, g, or t
  misc_feature (936)..(937): n is a, c, g, or t
  misc_feature (942)..(942): n is a, c, g, or t
  misc_feature (945)..(945): n is a, c, g, or t
  misc_feature (957)..(959): n is a, c, g, or t
  misc_feature (977)..(977): n is a, c, g, or t
  misc_feature (980)..(980): n is a, c, g, or t
  misc_feature (982)..(982): n is a, c, g, or t
  misc_feature (985)..(985): n is a, c, g, or t
  misc_feature (988)..(988): n is a, c, g, or t
gngnttttttttttttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaatctaaaaaaaaaaaaannaanaaaaaanntttgnggngcggccggcccnnnaaaaagttttaaaccctnctntnggngcncgggccccgtgggttttgcacacggggcaagggggccccaggaacaccgg

SEQ ID NO: 373490 - DNA, 1291 bp, Homo sapiens
  misc_feature (2)..(2): n is a, c, g, or t
  misc_feature (4)..(4): n is a, c, g, or t
gngnttttttttttttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaatctaaaaaaaaaaaaaagagtacaaaacaaaaacaacaaaaaatacaagaaaagacaaagaaaaggcacacaaaaagaacacacacggcacagcagcaaacaagaaagaaacacacgaaaaaacttggggggggggcgcgcctccacgtagagatggtctacaaaacaaactgtggggggggcccagcacacagaatatgaaagaacgacgaggtggcgcacaggtgttcttacaaagaaaccactcggctcaaaagaggggagcggtgtcgcccacaaaaaaaaaagcgcgcggcacacaggcgtgtgtgacagcaccagaggggtgcgggaatcaggaagtaacaggaggcaccagggcataaaaatacacggggggggcg

SEQ ID NO: 373491 - DNA, 275 bp, Homo sapiens
taatgcaatccatggaaatggacacacatatcaaattccactgcctcaaaccccaaatgactaagtgctggaatgccacgacatcccaaactgcttgaaataaatgggccatcagctgaggttagagaaaccttttttttaattatacagcaaaacgtctcaaaaaatatgtttgatccagagtggtggatcatagcaaaagcacattgaatgaatatgttcatgtccctgtcactatttaacttagcggggcctgcctgcagggtctaaggagt

SEQ ID NO: 373492 - DNA, 276 bp, Homo sapiens
actcttgtggtgacatctgtattttgtcatgttctgtactactaacgtagactttgataatagaagataacagtgaacagacctaagatgtgtaattaactgcttgctcctggagattattttaccttggtagaatagagaccttcatgagactcactccatccaatgctgtgctcttcagatgcagaaaagagtccaagtctctcctttgggccacaagagggcaccctgcagctagctaaccctccccttcttcagaacagcgttttccaaaga

SEQ ID NO: 373493 - DNA, 303 bp, Homo sapiens
tggcgagaatgtggaaaaaccagaaccctcatgagttgctggagagaatgtaaaattgtacagtcactataggaaaccatagagtggttcctcaaaaagttaaacactgaattaccatatgatgcagcaatcccactactgggtatacactgaaaaaaaattagaagcagggactcaaatatttggcttttttggttgtttttcttgtttttttgagatggagttttgctctgttgcccagggtagagtgcagtggctccatctctgctcactgtagcatcagcctcctgagttcaagcaatt

SEQ ID NO: 373494 - DNA, 216 bp, Homo sapiens
tgtgccaccacacatggctaattttttgtattttaaatagagacagggtttttaccatgttggccaggctggtctcaaactcctggcctcaagtgatccacccacctcagcctcccaaagtgctgggattacaggtgtgagccaccacacctggcctcatcctatttttaaaataaaataatttatttagaattcaaagaaagagtcttaacaact

SEQ ID NO: 373495 - DNA, 369 bp, Homo sapiens
caccgcagcagtggcccaagtgtttgaacggggcaacatgaactcagagcctgaggaagaggacggaggtttggaagatgaggacggggatgatgaagttgcagaggtggctgagaaagaaacccaggctgcttcaaaatattttcatgtgcagaaagtagctcgccaagatcccagagtggcacccatgtccaatctacttccagcaccagggctcccaccacatggacaacaagctaaagaagaccataccaaagatgcttccaaggcctcatcttctgtctccacagcaggacagctgaactggaatctggatgagcagctcaagcagaatggtggtttggcctggagtgatgatgcagatggagg

SEQ ID NO: 373496 - DNA, 817 bp, Homo sapiens
aaacacacacacattgggttggcttttattggaatgcctaggtgcaatctatagtcatcaagttatggaaaattcaggtcacatataaagttaagaaggcaaatgaaaagaacaatacaaatcagacaaaatttacatctcaaaatatcatgaaagcattttgactggctttgcctaaaatactttgaatatcaatttcttttttgtaagctaattcttttcattatacagtcccccaccccctcccaactcttagaaaaaggtcttttgtttacatattccccaaggtcactatttcttgtaaaagcatgtccagatcacaagtctttttagaaagaaataggctcattatacctactaacaggacactaattgggttgatttgacttcatcatctaaaataagcaccaggagatactccaaatctgttatttatcggtgcccgagtgaagaccagtccacgtcaagaagaggttaagactatgatctcacttctgtcatgtggcacaagcttttcatggtaatacatcagaaacatgtctgagaatttagactcagagcctatttcacccaaaagtacttacagcatgctaaatacaggcctgcagaagttccacggaacaggaactgcaaatacctaacagttaaaaaataaaatggaaaacagaatcatgtttatgtggtttgaaatctcatagttttctaaatttgggcttcataatacttgccaaggatttccgaattaaaaattttttgccatctgggttctcctataaaaatatcggtctttaaaattatatggttgctcaccataaag

SEQ ID NO: 373497 - DNA, 1084 bp, Homo sapiens
agacagccagatgaagcagcaatttgagggtagtaactggtgatgacaaagcccttctcaattttactttattaacttagccaaggcttagttcctgttttgcagcctgatggaaatttaatagatcatttgaagtatgtaatcacctgacatgctaagtgtctgtgtgtgccggagacacagaatggcaacctaaccccaccctgtccttgtctaggaaacacgctggagaagaaaggtggcaaggagtttgtggaagctgtcctggaactccggaaaaagaacgggcccttggaagtagctggagggtgaggtgggaaagccaccgtgcttatctggttgtgacacatgcagtattaggaaagccattttgtgagagggcttagaattcagaggtgtgtggcagcacagccgcatcttcaagatggaggccaaggacagcctgtagctttacatcttagagtttcaccacatgcaggttgtctgggaaaatcacctttgcatttttttttattacttaaaatagctcctatatgtttgatgtctagatcacaaattttaagaaattataggagctgagtttggtacatctaagagctgagagtgagtgatactgagccatctgcaaaactgctggtgagagatacaaattaaaaatcttcagccatctgtgtgtgtaagaggaaacatataaatacacatttctcatttgccaattacaccttccctggtataaggggaagaaaacgacttggcatctgatgtggggagaattattgctaagacctggaggcagggtacttcttactgcttcaggcctgaatttaggtggtcatttggggtgtgcaggacagagcacctcctaaggacctgagagtccagtcagtggggaggcccagctcccccaccaactgtgtgaggacagatcacccacttcctcacttggggctctggttttctcttcttactacccgattccaatgcctattgtgtcttttaaatcctctgttttaaaaatgaatcttaagctctctcggagggtccaccaggccgtgcacctctattcccagtgacaaatgacacc

SEQ ID NO: 373498 - DNA, 1476 bp, Homo sapiens
aatactgttctctgggttttcaagagaaatcccttgaaggtagacaaaatggtaaatgtcacaagaataaaaatcaaagcctgcaagttgactgctgcagacagaatggagaaacttgttgttttggttggcctgatggtccactttttttttttttaaacagatgccatgttttagtagccttctcagtgggatgccagctttataggcttttgcgaagtgaaacggggcattcattttatttcttttaacctttggaaatgatctcatgtgtgtgtttctctttttttggacttctcattcaaatgtttaatttaaacatgtcacatttgatattcctcctcctcctgtcctcacccccatccacatgtgcgcacactgcgtggactgattgccccttgggctcatatgttggaatcgaccaggtaggccagccctgccattggggcattagtaaatgtgcctgtgcgtgggtctcggtccaacacagttgatatacatttgtttacctgttatagttgcaagttgtacaggctgacattgcctcgatcgacagtgatgctgtcgttcacccgacaaacactgacttctacatcggtggtgaagtaggaaacacgctggagaagaaaggtggcaaggagtttgtggaagctgtcctggaactccggaaaaagaacgggcccttggaagtagctggagggtgaggtgggaaagccaccgtgcttatctggttgtgacacatgcagtattaggaaagccattttgtgagagggcttagaattcagaggtgtgtggcagcacagccgcatcttcaagatggaggccaaggacagcctgtagctttacatcttagagtttcaccacatgcaggttgtctgggaaaatcacctttgcatttttttttattacttaaaatagctcctatatgtttgatgtctagatcacaaattttaagaaattataggagctgagtttggtacatctaagagctgagagtgagtgatactgagccatctgcaaaactgctggtgagagatacaaattaaaaatcttcagccatctgtgtgtgtaagaggaaacatataaatacacatttctcatttgccaattacaccttccctggtataaggggaagaaaacgacttggcatctgatgtggggagaattattgctaagacctggaggcagggtacttcttactgcttcaggcctgaatttaggtggtcatttggggtgtgcaggacagagcacctcctaaggacctgagagtccagtcagtggggaggcccagctcccccaccaactgtgtgaggacagatcacccacttcctcacttggggctctggttttctcttcttactacccgattccaatgcctattgtgtcttttaaatcctctgttttaaaaatgaatcttaagctctctcggagggtccaccaggccgtgcacctctattcccagtgacaaatgacacc

SEQ ID NO: 373499 - DNA, 709 bp, Homo sapiens
ggagggaggggagtagagggcaggcccccatttaagtacccgggatggggcaccaatgccttcaggcggtaaaccaatttaggaagacgtggcgggctttgtggcggctcctcctctttcggcctgtccgcagtttttaaaaaacgtgtgtgatgataaggaatgactgtctacattagtaattcccaacttgggtccgaaagtgaacttttgctgaagcgaagtagctaaccgcttccatgtgcaaggcaggttccagacttcggggtgaggaggattaactgaaggaccccaggggaaccgggtgcgcagtaattgatcttggggcagaccagggcttggcggtggcctgtatctaaagacagcggggtctctgaggcggggcaggggggagttggcattgactggggagggaagagcgatcgctggtaacagccattgtgccttcccactgggttagtgggaaggttcctaaagatgccgtggcagcgacagtcccgtgctcagagccaggcacacagtaggcgttcactcgagacgcagagtctgggacgcgccctgaagaagctcctctccaggggcctggcccttcccaaggactgggctctgggcgtccccggggtcatgggtcagacctcgcgtccggggtgcgggctggtgcctgggcgcagagcggccggcgtcaacgggtagggcgcgggcccggggt

SEQ ID NO: 373500 - DNA, 1934 bp, Homo sapiens
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgtt

SEQ ID NO: 373501 - DNA, 2355 bp, Homo sapiens
  misc_feature (2355)..(2355): n is a, c, g, or t
ggagggaggggagtagagggcaggcccccatttaagtacccgggatggggcaccaatgccttcaggcggtaaaccaatttaggaagacgtggcgggctttgtggcggctcctcctctttcggcctgtccgcagtttttaaaaaacgtgtgtgatgataaggaatgactgtctacattagtaattcccaacttgggtccgaaagtgaacttttgctgaagcgaagtagctaaccgcttccatgtgcaaggcaggttccagacttcgggtgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373502 - DNA, 2336 bp, Homo sapiens
  misc_feature (2336)..(2336): n is a, c, g, or t
ggagggaggggagtagagggcaggcccccatttaagtacccgggatggggcaccaatgccttcaggcggtaaaccaatttaggaagacgtggcgggctttgtggcggctcctcctctttcggcctgtccgcagtttttaaaaaacgtgtgtgatgataaggaatgactgtctacattagtaattcccaacttgggtccgaaagtgaacttttgctgaagcgaagtagctaaccgcttccatgtgcaagtgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373503 - DNA, 2259 bp, Homo sapiens
  misc_feature (6)..(6): n is a, c, g, or t
  misc_feature (2259)..(2259): n is a, c, g, or t
gaaagnaccaaggaccttacggctaggtacgaggctgtgtcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgcggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373504 - DNA, 2077 bp, Homo sapiens
  misc_feature (6)..(6): n is a, c, g, or t
  misc_feature (2077)..(2077): n is a, c, g, or t
gaaagnaccaaggaccttacggctaggtacgaggctgtgtcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgccggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373505 - DNA, 1755 bp, Homo sapiens
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgcagtgtgcttccgcactgcaggtgctgccgggagtgtcgcagtgtgcttccg

SEQ ID NO: 373506 - DNA, 2224 bp, Homo sapiens
  misc_feature (2224)..(2224): n is a, c, g, or t
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373507 - DNA, 1615 bp, Homo sapiens
  misc_feature (1595)..(1595): n is a, c, g, or t
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagntattgcggatcctcgatcac

SEQ ID NO: 373508 - DNA, 1606 bp, Homo sapiens
  misc_feature (1606)..(1606): n is a, c, g, or t
cacattctgacccttccgtctgtgcaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373509 - DNA, 1573 bp, Homo sapiens
  misc_feature (33)..(33): n is a, c, g, or t
  misc_feature (1573)..(1573): n is a, c, g, or t
tcagaatatacaattttgagaaaaactgaaggntctttccaatggtacagtcttcgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373510 - DNA, 1980 bp, Homo sapiens
  misc_feature (1980)..(1980): n is a, c, g, or t
aagccagccagcagtcacagtgatggggacagccttaaaggcccatagtcacttggaagacaatggcagagcccttaggggtttgcccaagccaggtaggatgttagcaccagcctagtgctcaaggatgaggacagtcacatccaccagcccccaaccctcagcaatgagtactcattctaggtcctgatagctgccttactttggcccccagatcacaagtccctttaaaggaaagctgatctcctcgtccactgtggcttgtgcttccttttgtcccaggtgccacccacgggctctgaacattcatcctagtttgcttgctcccgcatcccgagcagcatttgagtcttatgtttgaaatgggttcatttgagccagcaactccctgcttcccttttgtgcctcgtgcacttggagtgtccactgtcctttacctgtatcccaaggctccttctctgagacttcccagctctcctgttatttcccacctcatgcttttctttgcagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373511 - DNA, 1979 bp, Homo sapiens
  misc_feature (1979)..(1979): n is a, c, g, or t
aatactgttctctgggttttcaagagaaatcccttgaaggtagacaaaatggtaaatgtcacaagaataaaaatcaaagcctgcaagttgactgctgcagacagaatggagaaacttgttgttttggttggcctgatggtccactttttttttttttaaacagatgccatgttttagtagccttctcagtgggatgccagctttataggcttttgcgaagtgaaacggggcattcattttatttcttttaacctttggaaatgatctcatgtgtgtgtttctctttttttggacttctcattcaaatgtttaatttaaacatgtcacatttgatattcctcctcctcctgtcctcacccccatccacatgtgcgcacactgcgtggactgattgccccttgggctcatatgttggaatcgaccaggtaggccagccctgccattggggcattagtaaatgtgcctgtgcgtgggtctcggtccaacacagttgatatacatttgtttacctgttatagttgcaagttgtacaggctgacattgcctcgatcgacagtgatgctgtcgttcacccgacaaacactgacttctacatcggtggtgaagtaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373512 - DNA, 1765 bp, Homo sapiens
  misc_feature (1765)..(1765): n is a, c, g, or t
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373513 - DNA, 1440 bp, Homo sapiens
  misc_feature (1440)..(1440): n is a, c, g, or t
ttgcatatttctttcttggaaaaggtaaaagactggaaagacttgttcacaaaggaaaaattgaccagtgctttaagaagacaccagatattaattccttgtggcagagtggagatgtgtggaaggaggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373514 - DNA, 1107 bp, Homo sapiens
  misc_feature (1107)..(1107): n is a, c, g, or t
tttaaactgaaggtggggtacatggcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373515 - DNA, 2136 bp, Homo sapiens
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggtaattggggacggggttcggcaccaccagctgtcagatgaaaagttatggaacccagaatttaggcatttcatcttcccagactttacagtggtcaagccaaatttccaaatccaagattgatatttgagtgtagacgctgaatatcaacttactccaggccattccaagtgtaaacggtctgtttcattaagtgtgattggctactctctcctcaattgcaaatacattgccatctgaattctcttccataatgatcaaactgactgctggttacttggggagggatttttaaacgtgttggtttttgtttgtttttttgtttttactttagaactgaaaaatctcaggtaactacaaaatgatagtttctccatttaaaccttaattagaaatgacaaagcttgaaagagaagacaggccacatcagtatgctattaagctgtctttagtccacaatttactaccatcacttcaacttttctttagaactgaaaacagtatatgactgaatgccaccttcttgaattatttggctagaggatggtattaaacagaagggcaatatctccaagtgagttcttatggaggaaaactgccccagagccatggtgtctccctgttcaagatggcagatggttcagggcagactgagaggtgcccctcaagtgtcctgcctctatggctttatctttgcatatgtggcactgtcagctcaatggcacgacagggctgctctgctgctcttcgatgtagaggcttgccaggggaaataggcacacagatgcagcctccttcctaaccctcaactgcaatctattttgtatcccttgagctctcagcttctgctgtttttgtcagatagcagacttccttactgggagatacactcattccatgggcccaggcctgacccacacgaactgggtgcaacagtgggctgaaaacatgaggactggactcaagagtgtccagcttgaacttgttttccaactgccttatacagatacttaaaaaaaaaaaggccacaagctagaaaaagcaaggattctatccaaagcacattttatactaaaatacaaaggccaggtgcagtggctcacacctgtaactccagcgttttgggaggctgaggcaggaggattgagtgaggccaggattcgaagctgcagtgagctatgattgtgccactgcactccagcctaggcaacagcaagatcctatctgt

SEQ ID NO: 373516 - DNA, 2218 bp, Homo sapiens
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggtaattggggacggggttcggcaccaccagctgtcagatgaaaagttatggaacccagaatttaggcatttcatcttcccagactttacagtggtcaagccaaatttccaaatccaagattgatatttgagtgtagacgctgaatatcaacttactccaggccattccaagtgtaaacggtctgtttcattaagtgtgattggctactctctcctcaattgcaaatacattgccatctgaattctcttccataatgatcaaactgactgctggttacttggggagggatttttaaacgtgttggtttttgtttgtttttttgtttttactttagaactgaaaaatctcaggtaactacaaaatgatagtttctccatttaaaccttaattagaaatgacaaagcttgaaagagaagacaggccacatcagtatgctattaagctgtctttagtccacaatttactaccatcacttcaacttttctttagaactgaaaacagtatatgactgaatgccaccttcttgaattatttggctagaggatggtattaaacagaagggcaatatctccaagtgagttcttatggaggaaaactgccccagagccatggtgtctccctgttcctatggctttatctttgcatatgtggcactgtcagctcaatggcacgacagggctgctctgctgctcttcgatgtagaggcttgccaggggaaataggcacacagatgcagcctccttcctaaccctcaactgcaatctattttgtatcccttgagctctcagcttctgctgtttttgtcagatagcagacttccttactgggagatacactcattccatgggcccaggcctgacccacacgaactgggtgcaacagtgggctgaaaacatgaggactggactcaagagtgtccagcttgaacttgttttccaactgccttatacagatacttaaaaaaaaaaaggccacaagctagaaaaagcaaggattctatccaaagcacattttatactaaaatacaaaggccaggtgcagtggctcacacctgtaactccagcgttttgggaggctgaggcaggaggattgagtgaggccaggagttggagaccaacctgggcaagatagtgagacctcatctctacaaaaaataaaaaacttagctgggcttggtgacacgtgcctgtagtctcagctactcaggaggctgaggcaggaggattgcttgagcccaggagttcgaagctgcagtgagctatgattgtgccactgcactccagcctaggcaacagcaagatcctatctgt

SEQ ID NO: 373517 - DNA, 1232 bp, Homo sapiens
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctagttgcaagttgtacaggctgacattgcctcgatcgacagtgatgctgtcgttcacccgacaaacactgacttctacatcggtggtgaagtaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcactaccttcgcgagactcgacctgtcatgcgagtcagcacgcacacatagcgaattcggtaccgagctcgatc

SEQ ID NO: 373518 - DNA, 1409 bp, Homo sapiens
  misc_feature (1409)..(1409): n is a, c, g, or t
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373519 - DNA, 932 bp, Homo sapiens
  misc_feature (932)..(932): n is a, c, g, or t
tttaaactgaaggtggggtacatggaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373520 - DNA, 905 bp, Homo sapiens
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaaggtaggcagatgcgcggcctcagtctactcgagggccccaagggacaggtgggcacaggctacttccactggaaggctgtgggggatcccgggggcca

SEQ ID NO: 373521 - DNA, 1274 bp, Homo sapiens
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagccgccccagtgatgcaactttgccaggacgccatggttttgtaaaagacaattcacttttattgaaaataaaaatgatgcaaaggcttttaagacctgagaatgagagttaactaatatttctttattgacatcaaaaaggggtgggaagaaagaattaaactcttcttaattttttaatcctatacttaaagaattaaaggaatgaatttgacgttccaagttaatctgtgtttagtttgagtgtggtaacaaacttggatctgaagctgcatcatttttaaaccctcactgtcaatttcttttgcatcacagtgacacggttccctcgctcacgtcattgcaagttctcctcctacccctttccctctttctgtcactaattgcactctctctcatgatgcaattcctgtggtggactctgtgttccagaaaataaccattactgtttacatttttaaccattc

SEQ ID NO: 373522 - DNA, 960 bp, Homo sapiens
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagtgacacggttccctcgctcacgtcattgcaagttctcctcctacccctttccctctttctgtcactaattgcactctctctcatgatgcaattcctgtggtggactctgtgttccagaaaataaccattactgtttacatttttaaccattc

SEQ ID NO: 373523 - DNA, 726 bp, Homo sapiens
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaaggtatgtgatttggccagaatgtatga

SEQ ID NO: 373524 - DNA, 1974 bp, Homo sapiens
aagccagccagcagtcacagtgatggggacagccttaaaggcccatagtcacttggaagacaatggcagagcccttaggggtttgcccaagccaggtaggatgttagcaccagcctagtgctcaaggatgaggacagtcacatccaccagcccccaaccctcagcaatgagtactcattctaggtcctgatagctgccttactttggcccccagatcacaagtccctttaaaggaaagctgatctcctcgtccactgtggcttgtgcttccttttgtcccaggtgccacccacgggctctgaacattcatcctagtttgcttgctcccgcatcccgagcagcatttgagtcttatgtttgaaatgggttcatttgagccagcaactccctgcttcccttttgtgcctcgtgcacttggagtgtccactgtcctttacctgtatcccaaggctccttctctgagacttcccagctctcctgttatttcccacctcatgcttttctttgcagctgaaccttattcacagtgaaatcagtaatttagccggctttgaggtggaggccataatcaatcctaccaatgctgacattgaccttaaagatgacctaggtaattggggacggggttcggcaccaccagctgtcagatgaaaagttatggaacccagaatttaggcatttcatcttcccagactttacagtggtcaagccaaatttccaaatccaagattgatatttgagtgtagacgctgaatatcaacttactccaggccattccaagtgtaaacggtctgtttcattaagtgtgattggctactctctcctcaattgcaaatacattgccatctgaattctcttccataatgatcaaactgactgctggttacttggggagggatttttaaacgtgttggtttttgtttgtttttttgtttttactttagaactgaaaaatctcaggtaactacaaaatgatagtttctccatttaaaccttaattagaaatgacaaagcttgaaagagaagacaggccacatcagtatgctattaagctgtctttagtccacaatttactaccatcacttcaacttttctttagaactgaaaacagtatatgactgaatgccaccttcttgaattatttggctagaggatggtattaaacagaagggcaatatctccaagtgagttcttatggaggaaaactgccccagagccatggtgtctccctgttcaagatggcagatggttcagggcagactgagaggtgcccctcaagtgtcctgcctctatggctttatctttgcatatgtggcactgtcagctcaatggcacgacagggctgctctgctgctcttcgatgtagaggcttgccaggggaaataggcacacagatgcagcctccttcctaaccctcaactgcaatctattttgtatcccttgagctctcagcttctgctgtttttgtcagatagcagacttccttactgggagatacactcattccatgggcccaggcctgacccacacgaactgggtgcaacagtgggctgaaaacatgaggactggactcaagagtgtccagcttgaacttgttttccaactgccttatacagatacttaaaaaaaaaaaggccacaagctagaaaaagcaaggattctatccaaagcacattttatactaaaatacaaaggccaggtgcagtggctcacacctgtaactccagcgttttgggaggctgaggcaggaggattgagtgaggccaggagttggagaccaacctgggcaagatagtgagacctcatctctacaaaaaataaaaaacttagctgggcttggtgacacgtgcctgtagtctcagctactcaggaggctgaggcaggaggattgcttgagcccaggagttcgaagctgcagtgagctatgattgtgccactgcactccagcctaggcaacagcaagatcctatctgt

SEQ ID NO: 373525 - DNA, 1332 bp, Homo sapiens
ggagggaggggagtagagggcaggcccccatttaagtacccgggatggggcaccaatgccttcaggcggtaaaccaatttaggaagacgtggcgggctttgtggcggctcctcctctttcggcctgtccgcagtttttaaaaaacgtgtgtgatgataaggaatgactgtctacattagtaattcccaacttgggtccgaaagtgaacttttgctgaagcgaagtagctaaccgcttccatgtgcaagtgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagccgccccagtgatgcaactttgccaggacgccatggttttgtaaaagacaattcacttttattgaaaataaaaatgatgcaaaggcttttaagacctgagaatgagagttaactaatatttctttattgacatcaaaaaggggtgggaagaaagaattaaactcttcttaattttttaatcctatacttaaagaattaaaggaatgaatttgacgttccaagttaatctgtgtttagtttgagtgtggtaacaaacttggatctgaagctgcatcatttttaaaccctcactgtcaatttcttttgcatcacagtgacacggttccctcgctcacgtcattgcaagttctcctcctacccctttccctctttctgtcactaattgcactctctctcatgatgcaattcctgtggtggactctgtgttccagaaaataaccattactgtttacatttttaaccattc

SEQ ID NO: 373526 - DNA, 787 bp, Homo sapiens
ggcaggcagctcctgtgggagatggggacccttggttagtctggaggaggagctgcttctgtgggataaactggtcatcagatagcaccagccagggaatcaggcagaagtcaagccttggtggtggaaggtgaacaacctagccggcagcctgcttgtcctggggggcactaacggtagagcctcaggtctgattcagggctctacaggggattgttttcagactgtactgatgggtgcactgggtttcttcactgaaccaccagatgactcttccagctaattgtttgtttgttttaaccatgggcaatatattttcagccgccccagtgatgcaactttgccaggacgccatggttttgtaaaagacaattcacttttattgaaaataaaaatgatgcaaaggcttttaagacctgagaatgagagttaactaatatttctttattgacatcaaaaaggggtgggaagaaagaattaaactcttcttaattttttaatcctatacttaaagaattaaaggaatgaatttgacgttccaagttaatctgtgtttagtttgagtgtggtaacaaacttggatctgaagctgcatcatttttaaaccctcactgtcaatttcttttgcatcacagtgacacggttccctcgctcacgtcattgcaagttctcctcctacccctttccctctttctgtcactaattgcactctctctcatgatgcaattcctgtggtggactctgtgttccagaaaataaccattactgtttacatttttaaccattc

SEQ ID NO: 373527 - DNA, 2048 bp, Homo sapiens
ggagggaggggagtagagggcaggcccccatttaagtacccgggatggggcaccaatgccttcaggcggtaaaccaatttaggaagacgtggcgggctttgtggcggctcctcctctttcggcctgtccgcagtttttaaaaaacgtgtgtgatgataaggaatgactgtctacattagtaattcccaacttgggtccgaaagtgaacttttgctgaagcgaagtagctaaccgcttccatgtgcaaggcaggttccagacttcggggtgaggaggattaactgaaggaccccaggggaaccggtgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgtt

SEQ ID NO: 373528 - DNA, 988 bp, Homo sapiens
ggagggaggggagtagagggcaggcccccatttaagtacccgggatggggcaccaatgccttcaggcggtaaaccaatttaggaagacgtggcgggctttgtggcggctcctcctctttcggcctgtccgcagtttttaaaaaacgtgtgtgatgataaggaatgactgtctacattagtaattcccaacttgggtccgaaagtgaacttttgctgaagcgaagtagctaaccgcttccatgtgcaaggcaggttccagacttcgggtgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaagccgagcagaagggccggaatcagagaagtgagcagaggagcaggcgaagaacggggcctgcgaggtggaattccgcacgagtacgtcggcgaaatcgagacagcatgaagcgggcaacacacgccggtaacaagaacggaagtatagttttcctgatgctttccgccccccagcgcctgccctcccccttctccaccccaaaacgaaagcaacaaacaagaacaaacaacacagccccaaagaaca

SEQ ID NO: 373529 - DNA, 2278 bp, Homo sapiens
  misc_feature (2278)..(2278): n is a, c, g, or t
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373530 - DNA, 1938 bp, Homo sapiens
  misc_feature (6)..(6): n is a, c, g, or t
gaaagnaccaaggaccttacggctaggtacgaggctgtgtcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgtt

SEQ ID NO: 373531 - DNA, 2153 bp, Homo sapiens
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgtttaaaaaaaaagaggtggttaaaattcatgggccgtgtttcaccgtctgactggcctggggttcccaattattcgctggaggaatcccctttggcgctgggtatacgggcggacgatggctccaccagttgagcgataggagggatgtacgccattgttatcacgtaacatacgacataatcattatagaggaggggctactcttaccaacgaggggggt

SEQ ID NO: 373532 - DNA, 2369 bp, Homo sapiens
  misc_feature (2369)..(2369): n is a, c, g, or t
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctagttgcaagttgtacaggctgacattgcctcgatcgacagtgatgctgtcgttcacccgacaaacactgacttctacatcggtggtgaagtaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373533 - DNA, 2269 bp, Homo sapiens
  misc_feature (2269)..(2269): n is a, c, g, or t
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagttgcaagttgtacaggctgacattgcctcgatcgacagtgatgctgtcgttcacccgacaaacactgacttctacatcggtggtgaagtaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373534 - DNA, 2178 bp, Homo sapiens
  misc_feature (2178)..(2178): n is a, c, g, or t
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373535 - DNA, 2103 bp, Homo sapiens
  misc_feature (2103)..(2103): n is a, c, g, or t
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373536 - DNA, 1402 bp, Homo sapiens
  misc_feature (1402)..(1402): n is a, c, g, or t
gacacagggcattggagggcccaggaagatataccgtggcaggggagtgggtctgtgtttggcatcttgtgctttgcagtgaaccagagctcactgtttctgtttcatccccgcaccactagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373537 - DNA, 2026 bp, Homo sapiens
  misc_feature (2026)..(2026): n is a, c, g, or t
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaaaaaaaaaaaaaaaaaaaaaaagggggggggggaaaaaattcccgcggagggggccccaagttcaagcagagtatccccaagggttcttttggtggaacaagggggggcgccccataaaggaggagcggggaatataaaagcgcagggggacgctggcgccagggcggtaaaaacaaacggcgccgagcaccgggggcaacacccgcgcgacgaccgggggacagtcgcgggggaagagaccccatatattgtcgggggggggggcagcccatagtgcggccgaacttccctaacgaaggaagatataaagcagcgaaggggcaacatn

SEQ ID NO: 373538 - DNA, 1775 bp, Homo sapiens
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagggtgaggtgggaaagccaccgtgcttatctggttgtgacacatgcagtattaggaaagccattttgtgagagggcttagaattcagaggtgtgtggcagcacagccgcatcttcaagatggaggccaaggacagcctgtagctttacatcttagagtttcaccacatgcaggttgtctgggaaaatcacctttgcatttttttttattacttaaaatagctcctatatgtttgatgtctagatcacaaattttaagaaattataggagctgagtttggtacatctaagagctgagagtgagtgatactgagccatctgcaaaactgctggtgagagatacaaattaaaaatcttcagccatctgtgtgtgtaagaggaaacatataaatacacatttctcatttgccaattacaccttccctggtataaggggaagaaaacgacttggcatctgatgtggggagaattattgctaagacctggaggcagggtacttcttactgcttcaggcctgaatttaggtggtcatttggggtgtgcaggacagagcacctcctaaggacctgagagtccagtcagtggggaggcccagctcccccaccaactgtgtgaggacagatcacccacttcctcacttggggctctggttttctcttcttactacccgattccaatgcctattgtgtcttttaaatcctctgttttaaaaatgaatcttaagctctctcggagggtccaccaggccgtgcacctctattcccagtgacaaatgacacc

SEQ ID NO: 373539 - DNA, 2272 bp, Homo sapiens
gccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggtaattggggacggggttcggcaccaccagctgtcagatgaaaagttatggaacccagaatttaggcatttcatcttcccagactttacagtggtcaagccaaatttccaaatccaagattgatatttgagtgtagacgctgaatatcaacttactccaggccattccaagtgtaaacggtctgtttcattaagtgtgattggctactctctcctcaattgcaaatacattgccatctgaattctcttccataatgatcaaactgactgctggttacttggggagggatttttaaacgtgttggtttttgtttgtttttttgtttttactttagaactgaaaaatctcaggtaactacaaaatgatagtttctccatttaaaccttaattagaaatgacaaagcttgaaagagaagacaggccacatcagtatgctattaagctgtctttagtccacaatttactaccatcacttcaacttttctttagaactgaaaacagtatatgactgaatgccaccttcttgaattatttggctagaggatggtattaaacagaagggcaatatctccaagtgagttcttatggaggaaaactgccccagagccatggtgtctccctgttcaagatggcagatggttcagggcagactgagaggtgcccctcaagtgtcctgcctctatggctttatctttgcatatgtggcactgtcagctcaatggcacgacagggctgctctgctgctcttcgatgtagaggcttgccaggggaaataggcacacagatgcagcctccttcctaaccctcaactgcaatctattttgtatcccttgagctctcagcttctgctgtttttgtcagatagcagacttccttactgggagatacactcattccatgggcccaggcctgacccacacgaactgggtgcaacagtgggctgaaaacatgaggactggactcaagagtgtccagcttgaacttgttttccaactgccttatacagatacttaaaaaaaaaaaggccacaagctagaaaaagcaaggattctatccaaagcacattttatactaaaatacaaaggccaggtgcagtggctcacacctgtaactccagcgttttgggaggctgaggcaggaggattgagtgaggccaggagttggagaccaacctgggcaagatagtgagacctcatctctacaaaaaataaaaaacttagctgggcttggtgacacgtgcctgtagtctcagctactcaggaggctgaggcaggaggattgcttgagcccaggagttcgaagctgcagtgagctatgattgtgccactgcactccagcctaggcaacagcaagatcctatctgt

SEQ ID NO: 373540 - DNA, 451 bp, Homo sapiens
gctactgccttctctaaaagcacatagcacatccttctgcaggtgccagctctctgcccagttgtctgtcccccatcccatcttctgggcactgggctttcccacactggcgtacaagcagacacggggctcaacagacaccgacccaacacaaggcaagctgcagcacagagggaggtggcctgtaaggtggggcaggtcctgcagcccccgtggcatcccagttgctgagtgcttatcttctcttctccaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgt

SEQ ID NO: 373541 - DNA, 1606 bp, Homo sapiens
  misc_feature (19)..(19): n is a, c, g, or t
  misc_feature (25)..(25): n is a, c, g, or t
aaccttaccgcgctaaggntagccngaggccctcgggggtgtgtgtacatcggccgggaaagtttctttggaggtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 373542 - DNA, 1485 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggcttccttctcactgctggatccggactttttaaataaaaacaagtaaaatttgtgttttaa

SEQ ID NO: 373543 - DNA, 2007 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 373544 - DNA, 1707 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 373545 - DNA, 2027 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaaaaaaagggggggcccggtac

SEQ ID NO: 373546 - DNA, 2286 bp, Homo sapiens
  misc_feature (2020)..(2020): n is a, c, g, or t
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaaaaaaaaaaaaaanaaacaaacacaacacgcaacacaacacaacacacacgagacacaaacacacaacacgagaaacacacaagcgccggggagacaacaaaaaggcgggggggaggagaaaagagcgaggaaaagaaacgcgggcacacgagcaccacgaaggatgaccgacgagcgcccggattagtatacgacaagaaggaggaggaacacacgacgaggacccaccaaaagagagggaaaacaaagaagcgaaagagagcgggagaaacacgaata

SEQ ID NO: 373547 - DNA, 2146 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaaaaaccaaaaaaagagccagtgcattctaggccatcttgagtcctggtgtaacgactaatttgcgaacgtgtcttgtttaaaatttcctagggggggcccgggccccaattccccttataaggggccggattaacacttc

SEQ ID NO: 373548 - DNA, 2008 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccaccgcccaccgcacaatgccagctctgcccactctaaggtcccgcccacttcccctcctcggaggacagccacgcgcacactggctctccgggaccaccaccagacacagggcagacagaaacccaccgtcagggtggagc

SEQ ID NO: 373549 - DNA, 1871 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacggccggctttgcccatcctgctctcctccagccgagggaccctggtgggggtggctccttctcactgctggatccggactttttaaataaaaacaagtaaaatttgtgttttaa

SEQ ID NO: 373550 - DNA, 1898 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacggcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 373551 - DNA, 1785 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggcttccttctcactgctggatccggactttttaaataaaaacaagtaaaatttgtgttttaa

SEQ ID NO: 373552 - DNA, 2287 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggaggtgagagtccctgcgctgagctgggggaggccccgggctcccgccccagcctcgaagccccgccccaggctggatttgaattgcttgtggctccgcccacagcccattttcctctggaagctgagaccccgccccgtgccagctgccacgcccctgacaggtcctctgccactctaagtccaggccccgcccaccgcacaatgccagctctgcccactctaaggtcccgcccacttccactccttgggggcggcaccctccccttggtcctgtgggcccgttctccagcagaaaaccacgcccaccaagcagaggccacgcccacaaccgaagtcaacgccaaccctgtactcaaacctcggcccatagttcctcagatcccctcacccctggccaggatccctctaacccaccgtgtcccgactgctgaccgggccctacctccatcttttccgggttcttcctcccagctaggccccgcccccatccccgcccatacgcgttaggccccgcccatgcccctctgagccctgccccagtacgccaggcccccctcccaacgacgcagcccggttctgcaccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 373553 - DNA, 2485 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagcccattttcctctggaagctgagaccccgccccgtgccagctgccacgcccctgacaggtcctctgccactctaagtccaggccccgcccaccgcacaatgccagctctgcccactctaaggtcccgcccacttccactccttgggggcggcaccctccccttggtcctgtgggcccgttctccagcagaaaaccacgcccaccaagcagaggccacgcccacaaccgaagtcaacgccaaccctgtactcaaacctcggcccatagttcctcagatcccctcacccctggccaggatccctctaacccaccgtgtcccgactgctgaccgggccctacctccatcttttccgggttcttcctcccagctaggccccgcccccatccccgcccatacgcgttaggccccgcccatgcccctctgagccctgccccagtacgccaggcccccctcccaacgacgcagcccggttctgcaccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 373554 - DNA, 1872 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 373555 - DNA, 1843 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 373556 - DNA, 2851 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaaggtgggaggggtcgggcgcggtggctcacgcctgtcatcccagcactttgggaggccgaggcgggtgtatcacctgaggtcagaccagcctggccaacatagtgaaaccctccccctctactaaaaatacaaaaattacctgggcgtggtggcgggtgcctgtaatcccagctactcgggaggctgaggcaggagaattgcttgaacccgggaggtggaggttgcagtgagccaagattgcgccattgcactctagccagggcgacagggcgagactccgtctcaaaaaaaaaaaaaaagaaaaagaaaaatgaaaggtgggaggggccggtgcgagcagttggggtcctgctctgtggggtgcgacctcagcccaggcagggcctccctccgtggggcacagtcccgtgggttgggcgggggaaagatacatagccagacaggagtgaagggggctcactcggtacagcgatgggggatgcccagacgcggggcactcaagtggggagctggagccggctgagcagcgctgacctagggtgcagggcgtggtccctggaggcctgggaggctgaccctgcccttcccctcccccgccagaagactcgagctctgggctcatgaacactctcctgaatggacacaaggtaagcgaccttcttcctctcaaagcacctgggggagaaaggtctggaggcttctagaaccctgagtcagagccagtgctcgcccagatgtgtgcaagcaggggcggtgccactgcaccgtgggatcgctgttgattgtactcccaccggggtgtcccaggagaccctcctaggcttggggcacacccagagagcgtggctgcctcctaccaccagtaaattgccaccttgtcccttcgtcttagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 373557 - DNA, 1299 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 373558 - DNA, 1055 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggtgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 373559 - DNA, 415 bp, Homo sapiens
cacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaagcttgtgagtgtgtaagcttgtttggggtggtgtggagggttcagaaggtgcagcctgggccccccatgacattccctgctgggggcgccaggcctgctctctttacctctagcagagcctcagagtttctcagatagggagacgggagccca

SEQ ID NO: 373560 - DNA, 1605 bp, Homo sapiens
ccagggggaagaaacatatgggctaggtacgaggctgggtggtgatcggccgaggggaaagtttctttggaggtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 373561 - DNA, 2271 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaaaaaaagaagaacaaaagaaatagaaaagaaacaaggaagaaaaaaaaaaagaaaaggggggggggggcctaaaaggttcccccggggggggccaagttgcgacacccactttgcttgcacaagggggggccccacagagagcagcgacattaagagagagacagcggcccccgatacaacacgtggagacgggggacacgcgaaacgggacaccactgagagaaagacacacacaccgggggggacactcagcggcaaccacga

SEQ ID NO: 373562 - DNA, 2045 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcaggcttcccctgcttcaagccttctggtgctgccccccagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 373563 - DNA, 3131 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggaggtgagagtccctgcgctgagctgggggaggccccgggctcccgccccagcctcgaagccccgccccaggctggatttgaattgcttgtggctccgcccacagcccattttcctctggaagctgagaccccgccccgtgccagctgccacgcccctgacaggtcctctgccactctaagtccaggccccgcccaccgcacaatgccagctctgcccactctaaggtcccgcccacttccactccttgggggcggcaccctccccttggtcctgtgggcccgttctccagcagaaaaccacgcccaccaagcagaggccacgcccacaaccgaagtcaacgccaaccctgtactcaaacctcggcccatagttcctcagatcccctcacccctggccaggatccctctaacccaccgtgtcccgactgctgaccgggccctacctccatcttttccgggttcttcctcccagctaggccccgcccccatccccgcccatacgcgttaggccccgcccatgcccctctgagccctgccccagtacgccaggcccccctcccaacgacgcagcccggttctgcaccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaaggtgggaggggtcgggcgcggtggctcacgcctgtcatcccagcactttgggaggccgaggcgggtgtatcacctgaggtcagaccagcctggccaacatagtgaaaccctccccctctactaaaaatacaaaaattacctgggcgtggtggcgggtgcctgtaatcccagctactcgggaggctgaggcaggagaattgcttgaacccgggaggtggaggttgcagtgagccaagattgcgccattgcactctagccagggcgacagggcgagactccgtctcaaaaaaaaaaaaaaagaaaaagaaaaatgaaaggtgggaggggccggtgcgagcagttggggtcctgctctgtggggtgcgacctcagcccaggcagggcctccctccgtggggcacagtcccgtgggttgggcgggggaaagatacatagccagacaggagtgaagggggctcactcggtacagcgatgggggatgcccagacgcggggcactcaagtggggagctggagccggctgagcagcgctgacctagggtgcagggcgtggtccctggaggcctgggaggctgaccctgcccttcccctcccccgccagaagactcgagctctgggctcatgaacactctcctgaatggacacaaggtaagcgaccttcttcctctcaaagcacctgggggagaaaggtctggaggcttctagaaccctgagtcagagccagtgctcgcccagatgtgtgcaagcaggggcggtgccactgcaccgtgggatcgctgttgattgtactcccaccggggtgtcccaggagaccctcctaggcttggggcacacccagagagcgtggctgcctcctaccaccagtaaattgccaccttgtcccttcgtcttagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 373564 - DNA, 1626 bp, Homo sapiens
atcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtcgtcggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaaggtaagcgaccttcttcctctcaaagcacctgggggagaaaggtctggaggcttctagaaccctgagtcagagccagtgctcgcccagatgtgtgcaagcaggggcggtgccactgcaccgtgggatcgctgttgattgtactcccaccggggtgtcccaggagaccctcctaggcttggggcacacccagagagcgtggctgcctcctaccaccagtaaattgccaccttgtcccttcgtcttagggtggggactgcgatggcttctccaccttcgatgttcccatcttcactgaagagttcttggaccaaaacaaaggtgagcggtaactgcgctcctgatgcgaactccgtgaaactgggtggtagaggggggcgtgggccaggagggccccaagactgcaggaggcggatcgggaggttccctatgagcgtccaggcgcacgctgtcgctccagaggctgatgtggagcaggaggcagagggcgcagtgagggaaacctgggcaggggcacgtcccgggcaaaagcccggaggtaggggaaaggggaggcgcaggctttgaccccgctccccccggcgcagtcctctagatcgaccagcagcaacactgcatg

SEQ ID NO: 373565 - DNA, 368 bp, Homo sapiens
actattattttgtctcagctctgtgactcccacatcacagacagccctcctagtaactgcccccttatccttttttgattttttaaatgtttatatttttttgagacatggtctcactctgttgcccaggctggagtgcagtagcacgaacatggctcactgcaaccttgacctcttaagctcgtgatcctcccacctcagcctcctaagtagctgggaccacaggtgcataccactacatctggccttatattttttaaattttcacagagacagggtctcactatattgcccaggctgatctcgaactcctaggctcaagtgatccttctgccttggcctcctaaagtgcccaggctgatcttgaa

SEQ ID NO: 373566 - DNA, 1091 bp, Homo sapiens
  misc_feature (4)..(4): n is a, c, g, or t
  misc_feature (7)..(7): n is a, c, g, or t
gganagnggttggttctgagaaggcttcaaggaataggcagacatttcagcaaggctgctgaggaaggataggctgtggaaattaggatgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtagggtataaagcccctcccgctcacagtttccctagtcctcgaaggctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgtta

SEQ ID NO: 373567 - DNA, 2335 bp, Homo sapiens
  misc_feature (4)..(4): n is a, c, g, or t
  misc_feature (7)..(7): n is a, c, g, or t
gganagnggttggttctgagaaggcttcaaggaataggcagacatttcagcaaggctgctgaggaaggataggctgtggaaattaggatgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtagggtataaagcccctcccgctcacagtttccctagtcctcgaaggctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgttactggtgtccagctgagtttctcttgggtataaaggctaaaagggaaaaaggatatgtggagaatcatcaagatatgaattgaatcgctgcgatactggcatttccctactccccaactgagttcaagggctgtaggttcatgcccaagccctgagagtgggtactagaaaaaacgagattgcacagttggagagagcaggtgtgttaaatgggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttgggacaattgcttactcattaaaaataatagagccccacttgacactattcactaaaattaatctggaatttaaggcccaacattaaacacaaagctgttgaaatattgatgaaaatgtaagaatttttgtgaccacggggtaggagaagtttctttaaagacgtaaaaagaaaaaaaccataggctgctctgcctgtggagtagccattctttattcttttactttttaaaataataacaatcacaaaggaaagatttgccaattgaataggatcaaattctacaacttttcctaaggcacccacaaataaatgacaagtgagacaaaaagcactagtataaagattatataaagacctataaatcattaagacaactgagtttttaaaaatggacaaaatccatgaacaatttataaaatagaaatatagccaaaaatgtctaaaagatgtttatgatgtaaggaattatcaattacaacagtgagaaaccatatttccttctatccgatgagtaaaaagtttctaaagtgttggcaaggcttaggaaagtgatatgcatttcctgctggtcaagttgtaaattagtatagctactttggaggacaattgtaaaatttaaatcatatcctatgacccagcaattccatgctataaaaactcatccatggccgggcttggtggctcacgcctgtaatcccagcactttgggaggctgaggtgggcagatcacgaggtcaagagatcgagaccatcctggccaacatgatgaaaccccgtttctactaaaaatacaaaaattagctgggcatggtggcatgtgcctatagtcccagctactcaggaggctgaggcaggagaattgcttgaacctgggag

SEQ ID NO: 373568 - DNA, 1494 bp, Homo sapiens
  misc_feature (4)..(4): n is a, c, g, or t
  misc_feature (7)..(7): n is a, c, g, or t
gganagnggttggttctgagaaggcttcaaggaataggcagacatttcagcaaggctgctgaggaaggataggctgtggaaattaggatgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtagggtataaagcccctcccgctcacagtttccctagtcctcgaaggctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgttactggtgtccagctgagtttctcttgggtataaaggctaaaagggaaaaaggatatgtggagaatcatcaagatatgaattgaatcgctgcgatactggcatttccctactccccaactgagttcaagggctgtaggttcatgcccaagccctgagagtgggtactagaaaaaacgagattgcacagttggagagagcaggtgtgttaaatgggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttgggacaattgcttactcattaaaaataatagagcccca

SEQ ID NO: 373569 - DNA, 1015 bp, Homo sapiens
  misc_feature (4)..(4): n is a, c, g, or t
  misc_feature (7)..(7): n is a, c, g, or t
gganagnggttggttctgagaaggcttcaaggaataggcagacatttcagcaaggctgctgaggaaggataggctgtggaaattaggatgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtagggtataaagcccctcccgctcacagtttccctagtcctcgaaggctcggaagcccgtcaccatgtcgtgcgagtcgtctatggttctcgggtactgggatattcgtgggctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgtta

SEQ ID NO: 373570 - DNA, 1130 bp, Homo sapiens
  misc_feature (4)..(4): n is a, c, g, or t
  misc_feature (7)..(7): n is a, c, g, or t
  misc_feature (1026)..(1026): n is a, c, g, or t
gganagnggttggttctgagaaggcttcaaggaataggcagacatttcagcaaggctgctgaggaaggataggctgtggaaattaggatgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtagggtataaagcccctcccgctcacagtttccctagtcctcgaaggctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagccagagctcgctgctgctgagccatctttncctgaggggcccacactcttagctcactgtcagtcttgttccatcctgtcctgagggcccccactctgtctcctctgctctttctaataaacagcagttgcatt

SEQ ID NO: 373571 - DNA, 715 bp, Homo sapiens
  misc_feature (4)..(4): n is a, c, g, or t
  misc_feature (7)..(7): n is a, c, g, or t
gganagnggttggttctgagaaggcttcaaggaataggcagacatttcagcaaggctgctgaggaaggataggctgtggaaattaggatgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtagggtataaagcccctcccgctcacagtttccctagtcctcgaaggctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgtgagtttccttagcacacatctgct

SEQ ID NO: 373572 - DNA, 355 bp, Homo sapiens
ctttaagtcttgggaagagcctaacttctataccttggaggcactgtctacaaaaaaatggaggaggtagacgcaggcaacacgtgaatgttgctgttctggtatgcatctgttggactgggttggggtcgttataagatttggtgtattttcctttcaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgtta

SEQ ID NO: 373573 - DNA, 1561 bp, Homo sapiens
  misc_feature (4)..(4): n is a, c, g, or t
  misc_feature (7)..(7): n is a, c, g, or t
gganagnggttggttctgagaaggcttcaaggaataggcagacatttcagcaaggctgctgaggaaggataggctgtggaaattaggatgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtagggtataaagcccctcccgctcacagtttccctagtcctcgaaggctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgttactggtgtccagctgagtttctcttgggtataaaggctaaaagggaaaaaggatatgtggagaatcatcaagatatgaattgaatcgctgcgatactggcatttccctactccccaactgagttcaagggctgtaggttcatgcccaagccctgagagtgggtactagaaaaaacgagattgcacagttggagagagcaggtgtgttaaatgggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttgggacaattgcttactcattaaaaataatagagccccacttgacactattcactaaaattaatctggaatttaaggcccaacattaaacacaaagctgttgaaat

SEQ ID NO: 373574 - DNA, 1422 bp, Homo sapiens
  misc_feature (4)..(4): n is a, c, g, or t
  misc_feature (7)..(7): n is a, c, g, or t
gganagnggttggttctgagaaggcttcaaggaataggcagacatttcagcaaggctgctgaggaaggataggctgtggaaattaggatgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtagggtataaagcccctcccgctcacagtttccctagtcctcgaaggctcggaagcccgtcaccatgtcgtgcgagtcgtctatggttctcgggtactgggatattcgtggggtgagtgccgtctcaacggtagagccgctcggtcaaagagactgacgcggagagggcgggtctctgggtccgcgatctccagcaggagcagctctacgcgggagccttttcgagctgccgagccacggatgtcgacccctgcccagcctctgggatcgcgggccctgtggggaggggcggaggagaccacgccggagccgggcctaggggccgcttaaccaccgccccggcaggacgcagggactcggcagccccgggccggggaacgttagcgggcgggggttgggaatgggtgggagctgcgcagtcgctgaaccgctgtcttccccagctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgtta

SEQ ID NO: 373575 - DNA, 1761 bp, Homo sapiens
  misc_feature (4)..(4): n is a, c, g, or t
  misc_feature (7)..(7): n is a, c, g, or t
gganagnggttggttctgagaaggcttcaaggaataggcagacatttcagcaaggctgctgaggaaggataggctgtggaaattaggatgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtagggtataaagcccctcccgctcacagtttccctagtcctcgaaggctcggaagcccgtcaccatgtcgtgcgagtcgtctatggttctcgggtactgggatattcgtggggtgagtgccgtctcaacggtagagccgctcggtcaaagagactgacgcggagagggcgggtctctgggtccgcgatctccagcaggagcagctctacgcgggagccttttcgagctgccgagccacggatgtcgacccctgcccagcctctgggatcgcgggccctgtggggaggggcggaggagaccacgccggagccgggcctaggggccgcttaaccaccgccccggcaggacgcagggactcggcagccccgggccggggaacgttagcgggcgggggttgggaatgggtgggagctgcgcagtcgctgaaccgctgtcttccccagctggcgcacgccatccgcctgctcctggagttcacggatacctcttatgaggagaaacggtacacgtgcggggaaggtaatgccgctccgcgtgcccgtgcagccaagctggccctccacctgccctggtcttcttacgcccagagggtggtggcgtcgcgccaaggccgggtgggacgtttgccccaatctgggtgaatagagacacatcctttatctggaactgggggttctctttttaacatagcccaaacccgtcttaatgcttaaccaaatagggctcagaggctcaatggttatgcttttggggcctgggaatttgaggtattgggaccaagtcatttctttagatcttttgctcttgtcaggtggggtattaaggaggttgggtcccacttaattccgtctcttacagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgtta

SEQ ID NO: 373576 - DNA, 2259 bp, Homo sapiens
  misc_feature (4)..(4): n is a, c, g, or t
  misc_feature (7)..(7): n is a, c, g, or t
gganagnggttggttctgagaaggcttcaaggaataggcagacatttcagcaaggctgctgaggaaggataggctgtggaaattaggatgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtagggtataaagcccctcccgctcacagtttccctagtcctcgaaggctcggaagcccgtcaccatgtcgtgcgagtcgtctatggttctcgggtactgggatattcgtgggctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgttactggtgtccagctgagtttctcttgggtataaaggctaaaagggaaaaaggatatgtggagaatcatcaagatatgaattgaatcgctgcgatactggcatttccctactccccaactgagttcaagggctgtaggttcatgcccaagccctgagagtgggtactagaaaaaacgagattgcacagttggagagagcaggtgtgttaaatgggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttgggacaattgcttactcattaaaaataatagagccccacttgacactattcactaaaattaatctggaatttaaggcccaacattaaacacaaagctgttgaaatattgatgaaaatgtaagaatttttgtgaccacggggtaggagaagtttctttaaagacgtaaaaagaaaaaaaccataggctgctctgcctgtggagtagccattctttattcttttactttttaaaataataacaatcacaaaggaaagatttgccaattgaataggatcaaattctacaacttttcctaaggcacccacaaataaatgacaagtgagacaaaaagcactagtataaagattatataaagacctataaatcattaagacaactgagtttttaaaaatggacaaaatccatgaacaatttataaaatagaaatatagccaaaaatgtctaaaagatgtttatgatgtaaggaattatcaattacaacagtgagaaaccatatttccttctatccgatgagtaaaaagtttctaaagtgttggcaaggcttaggaaagtgatatgcatttcctgctggtcaagttgtaaattagtatagctactttggaggacaattgtaaaatttaaatcatatcctatgacccagcaattccatgctataaaaactcatccatggccgggcttggtggctcacgcctgtaatcccagcactttgggaggctgaggtgggcagatcacgaggtcaagagatcgagaccatcctggccaacatgatgaaaccccgtttctactaaaaatacaaaaattagctgggcatggtggcatgtgcctatagtcccagctactcaggaggctgaggcaggagaattgcttgaacctgggag

SEQ ID NO: 373577 - DNA, 485 bp, Homo sapiens
acaaaattttttttttaagtagctgagcatgatggtatgtgcttgcagtttcatctactcaggaagctgaggtaggaggatggcttgaacccagcagtttaagactgtagtgagctatgatttatgccactgcactctccagcctgggcgatacagtgaaatcccatctcttaaaattaaaaaaaaaaaaaagccaagcatggtggctcacgcctgtaatcccagcactttgggaggccgaggtgggaggatcacaagatcaggagattgagaccatcccggctaacatggtgaaaccctgtctctactgaaaatacaaaaaaattagccaagcgtggtggcaggtgcctgtaatcccagctactcgggaagctgaggcaggagaatctcttgaacccgggaggtggaggttgcagtgagctgagatcacgccattgcactccagcctgggtgacagagtgagactccatctcaaaaaaataaat

SEQ ID NO: 373578 - DNA, 408 bp, Homo sapiens
ctgcctgtaaatgcatttccaggggagggcaggcctcccacatccccaggcagcactgtgagttccagagcaggagctcaggcggtggggccagcgtgtgcactgcagcggctgctgtggggcagtgatggcatgggggtctcaacttcctcgggtggcagcacgccctttcctttcctgcacgtctgtcatcagcagcggccttctcatgtggcttctctgggcgtttttgttttctttggggtgtttttgcctcgggttttataccacccttgtggtcggggcttctgggtggaaaatgaggtgttcgctggcttcctgcaatgtggggcttgtccgggcctgggacgctgcttgcatgtggcgctgtgtgcggcagtctgcccggccctgccacctccagggtgg

SEQ ID NO: 373579 - DNA, 341 bp, Homo sapiens
agcccagcttcttgaggaaattgttgagccgctacaccaagtcaggaacatctgtctgcagactgatggctacaggtgtattatgatgcttaagctactgtttagttgtctgttcatttcatcctggttgatgcattcagtgagtgaggcaaggagtgagcaacctgacatcaaagcttgctgaggacaggtgacatggacagacaactagaatcatgtcagctatccaaaaaaggatatcacatttaacaaaaaacagattcgaatatggtggctgtttctaatatgacttaaatccacaatggtttaaataatgcaaaaataaaagaaattttgtgcag

SEQ ID NO: 373580 - DNA, 290 bp, Homo sapiens
cattacatctggtaataggggcaaggctacgagactgtaaactataaaacaataaggagttctgtgaggtttctgtcacatttaggtcccttgagttttgcagagtttatgcagttttgtttcagcagcacagagcggaactgcaaagtgatgaaggactatattttgagttagtaaatattaatagctcctgatatatccagggtgttgtaccaagtgttctttaggatacaaagttatacaagatgtgagtcttgttgaatgtaaacccttaaggaacttaattccta

SEQ ID NO: 373581 - DNA, 1339 bp, Homo sapiens
gcggcccggaagtgcccggctgaagcggccgggcgccgattggtgtctttgagtctagtctttgttcggggctgtccaaaggacgctagctgttgcacctgttcctccctgcgcgtaagatagaggataaatctcctggcaaagcccagaatgaccacagccctggaacctgaggaccaaaaaggacttctgataattaaggcagaggaccattactggggacaggattccagctcacaaaagtgcagtcctcacaggagggaactctatagacaacacttcaggaagctctgctatcaggatgcacctggaccccgtgaagctcttacccagctgtgggagctctgccgtcagtggctgaggccagaatgccacaccaaggagcagattttagacctgctggtgctagaacagttcctgagcattcttcctaaagacctgcaagcatgggtgcgtgcacaccatccagagactggagaggaggcagtgacggtactggaggatctggagagagagcttgatgaacctggaaagcaggtcccaggcaattcagaaagacgggacatactcatggacaagttggcccccttgggaaggccatatgaatcactgactgtccagctccatcccaaaaagacccagctggagcaggaagctgggaaaccacaaaggaatggtgataaaactaggactaagaatgaagagttgttccagaaggaagatatgcccaaagacaaggaattccttggggagataaatgacagactgaacaaagatactcctcagcatcctaagtccaaagatattattgaaaatgagggcagatcagaatggcaacagagggaaagaagacgatataaatgtgatgaatgtgggaaaagtttcagtcatagctcagaccttagtaaacacaggagaactcacacgggagagaagccctataaatgtgatgagtgtggaaaagccttcattcagcgctcacatctcattggacatcatagagtacacacgggagtaaaaccctataaatgtaaagaatgtgggaaagacttcagtgggcgcacaggtcttattcagcatcagagaatccacacaggtgaaaaaccctatgaatgtgatgagtgtggaaggcctttccgagtaagttcagctcttattagacatcaaagaattcataccgcaaataaactctactaatatagcagtaatatcaaaagttctttggacactcaggcctaactagttatcaaagaatctattttagaaaccttgagtttcctcaatgtggtcaaagcttcagtcatcattaaacttctctggaccaaagaaaaaaaaaaaa

SEQ ID NO: 373582 - DNA, 943 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgagagagtcggggtttcaccgtgttagccaggatggtctcgatctcctgacctcgtgatccgcccacctccgcctctccaagtgctgggattacaggcatgagccaccgcgcccggcccttgtatttttaaactttgactttatggagacgaacaccatcgtttgctgaacacttgaaacatgatgaaagagccacagagttggcagaactgtttgaaaatgctgtgcaagcggtcttctctgtcttctttatggccagtaaaattctccagaagagatttatggcagcctcactcccagtagtttctgcatttagtgagataagccacagcaattgtctgctattttaaaagcactgtgatgcttaaatattccagctgctacatcggacaggtgtctgatgatcctgagaacagtcatcaaaaagtagaacttgagcctggaatacattctctggcatagccatagtcaatcaccagtataattaatgtaaatggacactggatagcttttttgtgaattctgatgcagcacaaagagactttaattgtttccaaaaagaaaatgtctgagattaaaatctagagttttatgactta

SEQ ID NO: 373583 - DNA, 490 bp, Homo sapiens
tcaagcctgtaatcccagcactttgggaggctgaggatggtctcgatctcctgacctcgtgatccgcccacctccgcctctccaagtgctgggattacaggcatgagccaccgcgcccggcccttgtatttttaaactttgactttatggagacgaacaccatcgtttgctgaacacttgaaacatgatgaaagagccacagagttggcagaactgtttgaaaatgctatttttagggcagtttttagtgtcattatgttgctgctacatatttggaagatggaacaagcccagacaaaggaggattcttttttactcatcttaaatccattttattttccttcatctgagccccttaaaactaatgtgttactggtgcaagcggtcttctctgtcttctttatggccagtaaaattctccagaagagatttatggcagcctcactcccagtagtttctgcatttagtgagataaggtaagttctgagaa

SEQ ID NO: 373584 - DNA, 3086 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgaggtgcgttccccagcctggtttgctctgggctctgacccgccgccgcgaatctccgctcgtaactccgggcctgaacctggaggagggaggatttcctctgtgcagctttcgagcggtagactcaccctgccaggcagacctagattggcataaccagagatcagttccagttgtgatgcagtgggtgtctacacacttctgatgacacctttattttaaaagctgatgttccaaggtgcaagcggtcttctctgtcttctttatggccagtaaaattctccagaagagatttatggcagcctcactcccagtagtttctgcatttagtgagataaggaatggattttcttctgtgtattgctgacacgaacaggagacggaaatactgagtagaagagggcggttccctggctaaggccccaccctcaagcctggatacccgcggccctaaatgagaagaggcgtttctgtttggggcccaaaaagttgccttttgacccaccacgccccctatcctgcccccatataaaccccaaaccccaacctccagagcataccagcaggtgaggagatacgaggcaagccgactgacggcaaaacgacgtagcagagaaagagagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtacgtgtgtgacccgatttttcctggattctggaaaagagctcggaatacagaaagctgtcccctggtcctttgcccttgtgaaaaagcagaaggtccattgagctggttaacactccagctgtctgtggtggccaagctgaaagagctttgtaacactggggttgcaggcacccacctctagacgctaccgcagagccagagcccaaagccctcaccccggcctctgcacttgcccatctgcgtgctccccctctcgcaaggggtttctgcagagggggctactgaacagatggaatcttgctctcttgctcagactggagtgcagtggcatgaccttggctcactgcaacctcacctctcgggttcaagcgattctgcctcagcctctcgagtagctgggactacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagataccctgagaataaaatctggatccagtgagaggaaagattctgggtgctcatgaaaaaagaaacaaaacaaaacttgggagcctcttgagagtgtacagcatcagcccttgccaactcttgtttatatgcatttaactttcagttaaccatgggaataattcatgaaaatccaatctacaaacaaaggccatcctaacgttcatgttattcttttccctaagaatctttcacaagagctataatcaagtagaattatgctttgatttgaattctaattcaattgaaaataaaaaatgagggccggacgcggtggctcatgcctgtaatcccagcgctttgggaggctgaggtggacggatcacgaggtcaggagatcgagaccatcctggctaacacggtgaaacccgatccctactaaaaatacaaaaaattagccgggcgtggtggcaggcgcctgtagtcccagctactcgggaggctgaggcaggagaatggcgtgaacccaggaggcagaggttgcagtgagccgagatcatgctactgcactccagcctgggcgacagagcgagactctgtgtataaataaataaataaataaataaataacgaaaaggttgccattgccctttctggggaaagtgataatgaggaaagactagtttcttaacccaagtcagctttagagtcggcaaggatgcaatttgaggtgatccaggaaaactctattagcatggtatttcccatacagattcatttcttttaggcctgaagtctttttggcacttcttaataaaatcacagatacctcttggaaaaaagcttatcctttatcaatttctatcagttaaccactcagatgaggataaaggcctgagtcagaaaggacagagagaggttccacaaagagataaaagatgagtggccataaggagtccttgaaaacacacctctctagcccatcaaaaaatgcagcaccttaaactcaagtccatcttactagcctttagcagtaccccaccactctcaaaatttccagcattaaatgtctcggagctatataaaaggcagacttaggtataagtaggaagagatatcaagggcttgggtatcatttcagcactaatggagcttatggcatgtatgaatgaacctgatgcgtggtctccacggtagattgttacaattgaggtcccacatttatgagattcccagtgaaaacaaatctcacagcttcacctgagagaaacattactgtcagtctcagatacaaaagcctgctgctattaggtacctatacacctgctgaaaatggaccagctttgctgtagtagtgcgcgcaggcaaa

SEQ ID NO: 373585 - DNA, 2979 bp, Homo sapiens
  misc_feature (46)..(46): n is a, c, g, or t
  misc_feature (51)..(51): n is a, c, g, or t
  misc_feature (53)..(53): n is a, c, g, or t
  misc_feature (205)..(205): n is a, c, g, or t
  misc_feature (209)..(209): n is a, c, g, or t
tgcccagcacagggcccagagcacagcaggtgcccaccacagcttngtccntnggacagaagaaatgaacaagagggctggcctcatttctgcccccttcctggccctggtgcatgctacaaaaggccaggggtcactgcggctctgaaatctactcattttcttgaaacacacagaaaagatgtttctgggatggatgtgtcangganaaaaaaaaaggctgaagttgagaattccagctcagcacatgtcctccagccctcacagacatgacgagggattaaaacgccttttctcctcatttgcccaacatctcaggagaaagccaagtggcgtccccatcagggctgtcctgggcacccgctggctacgaagacaacctcctcattagcctggctttcctctgaaaatgagctcacacagactgcattgtgcgtgcctgtgtgaacgtgtgtggtgtcaggtaccccttaccgtgcaagcggtcttctctgtcttctttatggccagtaaaattctccagaagagatttatggcagcctcactcccagtagtttctgcatttagtgagataaggaatggattttcttctgtgtattgctgacacgaacaggagacggaaatactgagtagaagagggcggttccctggctaaggccccaccctcaagcctggatacccgcggccctaaatgagaagaggcgtttctgtttggggcccaaaaagttgccttttgacccaccacgccccctatcctgcccccatataaaccccaaaccccaacctccagagcataccagcaggtgaggagatacgaggcaagccgactgacggcaaaacgacgtagcagagaaagagagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtacgtgtgtgacccgatttttcctggattctggaaaagagctcggaatacagaaagctgtcccctggtcctttgcccttgtgaaaaagcagaaggtccattgagctggttaacactccagctgtctgtggtggccaagctgaaagagctttgtaacactggggttgcaggcacccacctctagacgctaccgcagagccagagcccaaagccctcaccccggcctctgcacttgcccatctgcgtgctccccctctcgcaaggggtttctgcagagggggctactgaacagatggaatcttgctctcttgctcagactggagtgcagtggcatgaccttggctcactgcaacctcacctctcgggttcaagcgattctgcctcagcctctcgagtagctgggactacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagataccctgagaataaaatctggatccagtgagaggaaagattctgggtgctcatgaaaaaagaaacaaaacaaaacttgggagcctcttgagagtgtacagcatcagcccttgccaactcttgtttatatgcatttaactttcagttaaccatgggaataattcatgaaaatccaatctacaaacaaaggccatcctaacgttcatgttattcttttccctaagaatctttcacaagagctataatcaagtagaattatgctttgatttgaattctaattcaattgaaaataaaaaatgagggccggacgcggtggctcatgcctgtaatcccagcgctttgggaggctgaggtggacggatcacgaggtcaggagatcgagaccatcctggctaacacggtgaaacccgatccctactaaaaatacaaaaaattagccgggcgtggtggcaggcgcctgtagtcccagctactcgggaggctgaggcaggagaatggcgtgaacccaggaggcagaggttgcagtgagccgagatcatgctactgcactccagcctgggcgacagagcgagactctgtgtataaataaataaataaataaataaataacgaaaaggttgccattgccctttctggggaaagtgataatgaggaaagactagtttcttaacccaagtcagctttagagtcggcaaggatgcaatttgaggtgatccaggaaaactctattagcatggtatttcccatacagattcatttcttttaggcctgaagtctttttggcacttcttaataaaatcacagatacctcttggaaaaaagcttatcctttatcaatttctatcagttaaccactcagatgaggataaaggcctgagtcagaaaggacagagagaggttccacaaagagataaaagatgagtggccataaggagtccttgaaaacacacctctctagcccatcaaaaaatgcagcaccttaaactcaagtccatcttactagcctttagcagtaccccaccactctcaaaatttccagcattaaatgtctcggagctatataaaaggcagacttaggtataagtaggaagagatatcaagggcttgggtatcatttcagcactaatggagcttatggcatgtatgaatgaacctgatgcgtggtctccacggtagattgttacaattgaggtcccacatttatgagattcccagtgaaaacaaatctcacagcttcacctgagagaaacattactgtcagtctcagatacaaaagcctgctgctattaggtacctatacacctgctgaaaatggaccagctttgctgtagtagtgcgcgcaggcaaa

SEQ ID NO: 373586 - DNA, 3213 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgaggtgcgttccccagcctggtttgctctgggctctgacccgccgccgcgaatctccgctcgtaactccgggcctgaacctggaggagggaggatttcctctgtgcagctttcgagcggtagactcaccctgccaggcagacctagattggcataaccagagatcagttccagttgtgatgcagtgggtgtctacacacttctgatgacacctttattttaaaagctgatgttccaagtcgattcaccatgatcttggctggctgtcttcttccttcatggctgctagtaatgacaattcagtggctgtttcttcagctgtgcaaagttggaacatgtttgggagttcaacggcattggtttctggtgcaagcggtcttctctgtcttctttatggccagtaaaattctccagaagagatttatggcagcctcactcccagtagtttctgcatttagtgagataaggaatggattttcttctgtgtattgctgacacgaacaggagacggaaatactgagtagaagagggcggttccctggctaaggccccaccctcaagcctggatacccgcggccctaaatgagaagaggcgtttctgtttggggcccaaaaagttgccttttgacccaccacgccccctatcctgcccccatataaaccccaaaccccaacctccagagcataccagcaggtgaggagatacgaggcaagccgactgacggcaaaacgacgtagcagagaaagagagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtacgtgtgtgacccgatttttcctggattctggaaaagagctcggaatacagaaagctgtcccctggtcctttgcccttgtgaaaaagcagaaggtccattgagctggttaacactccagctgtctgtggtggccaagctgaaagagctttgtaacactggggttgcaggcacccacctctagacgctaccgcagagccagagcccaaagccctcaccccggcctctgcacttgcccatctgcgtgctccccctctcgcaaggggtttctgcagagggggctactgaacagatggaatcttgctctcttgctcagactggagtgcagtggcatgaccttggctcactgcaacctcacctctcgggttcaagcgattctgcctcagcctctcgagtagctgggactacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagataccctgagaataaaatctggatccagtgagaggaaagattctgggtgctcatgaaaaaagaaacaaaacaaaacttgggagcctcttgagagtgtacagcatcagcccttgccaactcttgtttatatgcatttaactttcagttaaccatgggaataattcatgaaaatccaatctacaaacaaaggccatcctaacgttcatgttattcttttccctaagaatctttcacaagagctataatcaagtagaattatgctttgatttgaattctaattcaattgaaaataaaaaatgagggccggacgcggtggctcatgcctgtaatcccagcgctttgggaggctgaggtggacggatcacgaggtcaggagatcgagaccatcctggctaacacggtgaaacccgatccctactaaaaatacaaaaaattagccgggcgtggtggcaggcgcctgtagtcccagctactcgggaggctgaggcaggagaatggcgtgaacccaggaggcagaggttgcagtgagccgagatcatgctactgcactccagcctgggcgacagagcgagactctgtgtataaataaataaataaataaataaataacgaaaaggttgccattgccctttctggggaaagtgataatgaggaaagactagtttcttaacccaagtcagctttagagtcggcaaggatgcaatttgaggtgatccaggaaaactctattagcatggtatttcccatacagattcatttcttttaggcctgaagtctttttggcacttcttaataaaatcacagatacctcttggaaaaaagcttatcctttatcaatttctatcagttaaccactcagatgaggataaaggcctgagtcagaaaggacagagagaggttccacaaagagataaaagatgagtggccataaggagtccttgaaaacacacctctctagcccatcaaaaaatgcagcaccttaaactcaagtccatcttactagcctttagcagtaccccaccactctcaaaatttccagcattaaatgtctcggagctatataaaaggcagacttaggtataagtaggaagagatatcaagggcttgggtatcatttcagcactaatggagcttatggcatgtatgaatgaacctgatgcgtggtctccacggtagattgttacaattgaggtcccacatttatgagattcccagtgaaaacaaatctcacagcttcacctgagagaaacattactgtcagtctcagatacaaaagcctgctgctattaggtacctatacacctgctgaaaatggaccagctttgctgtagtagtgcgcgcaggcaaa

SEQ ID NO: 373587 - DNA, 1965 bp, Homo sapiens
  misc_feature (152)..(152): n is a, c, g, or t
  misc_feature (217)..(217): n is a, c, g, or t
  misc_feature (226)..(226): n is a, c, g, or t
  misc_feature (229)..(229): n is a, c, g, or t
  misc_feature (232)..(232): n is a, c, g, or t
  misc_feature (239)..(239): n is a, c, g, or t
  misc_feature (251)..(251): n is a, c, g, or t
  misc_feature (256)..(256): n is a, c, g, or t
  misc_feature (258)..(258): n is a, c, g, or t
  misc_feature (261)..(261): n is a, c, g, or t
  misc_feature (265)..(265): n is a, c, g, or t
  misc_feature (270)..(270): n is a, c, g, or t
ccctctccccctcccctccctagcctcacccccccctacgaccctcgctccccttaacctcatccccctatcaccccctccctcccgccttggccacgcctccccctcgacttctccgcctccccccccccccccctgcgccatttctttgnccctttgtttttataggaatacgccccgcccaaacccccaaatttttctgaacccctggaaatcncgggggatnccngantttttgncctaggcccacncattnantgntacncagcngtgttttgccccccattttgaacttaaccgcagggctttttaattacccccgctccagatggaatcttgctctcttgctcagactggagtgcagtggcatgaccttggctcactgcaacctcacctctcgggttcaagcgattctgcctcagcctctcgagtagctgggactacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagataccctgagaataaaatctggatccagtgagaggaaagattctgggtgctcatgaaaaaagaaacaaaacaaaacttgggagcctcttgagagtgtacagcatcagcccttgccaactcttgtttatatgcatttaactttcagttaaccatgggaataattcatgaaaatccaatctacaaacaaaggccatcctaacgttcatgttattcttttccctaagaatctttcacaagagctataatcaagtagaattatgctttgatttgaattctaattcaattgaaaataaaaaatgagggccggacgcggtggctcatgcctgtaatcccagcgctttgggaggctgaggtggacggatcacgaggtcaggagatcgagaccatcctggctaacacggtgaaacccgatccctactaaaaatacaaaaaattagccgggcgtggtggcaggcgcctgtagtcccagctactcgggaggctgaggcaggagaatggcgtgaacccaggaggcagaggttgcagtgagccgagatcatgctactgcactccagcctgggcgacagagcgagactctgtgtataaataaataaataaataaataaataacgaaaaggttgccattgccctttctggggaaagtgataatgaggaaagactagtttcttaacccaagtcagctttagagtcggcaaggatgcaatttgaggtgatccaggaaaactctattagcatggtatttcccatacagattcatttcttttaggcctgaagtctttttggcacttcttaataaaatcacagatacctcttggaaaaaagcttatcctttatcaatttctatcagttaaccactcagatgaggataaaggcctgagtcagaaaggacagagagaggttccacaaagagataaaagatgagtggccataaggagtccttgaaaacacacctctctagcccatcaaaaaatgcagcaccttaaactcaagtccatcttactagcctttagcagtaccccaccactctcaaaatttccagcattaaatgtctcggagctatataaaaggcagacttaggtataagtaggaagagatatcaagggcttgggtatcatttcagcactaatggagcttatggcatgtatgaatgaacctgatgcgtggtctccacggtagattgttacaattgaggtcccacatttatgagattcccagtgaaaacaaatctcacagcttcacctgagagaaacattactgtcagtctcagatacaaaagcctgctgctattaggtacctatacacctgctgaaaatggaccagctttgctgtagtagtgcgcgcaggcaaa

SEQ ID NO: 373588 - DNA, 2085 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgaggtgcaagcggtcttctctgtcttctttatggccagtaaaattctccagaagagatttatggcagcctcactcccagtagtttctgcatttagtgagataagatggaatcttgctctcttgctcagactggagtgcagtggcatgaccttggctcactgcaacctcacctctcgggttcaagcgattctgcctcagcctctcgagtagctgggactacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagataccctgagaataaaatctggatccagtgagaggaaagattctgggtgctcatgaaaaaagaaacaaaacaaaacttgggagcctcttgagagtgtacagcatcagcccttgccaactcttgtttatatgcatttaactttcagttaaccatgggaataattcatgaaaatccaatctacaaacaaaggccatcctaacgttcatgttattcttttccctaagaatctttcacaagagctataatcaagtagaattatgctttgatttgaattctaattcaattgaaaataaaaaatgagggccggacgcggtggctcatgcctgtaatcccagcgctttgggaggctgaggtggacggatcacgaggtcaggagatcgagaccatcctggctaacacggtgaaacccgatccctactaaaaatacaaaaaattagccgggcgtggtggcaggcgcctgtagtcccagctactcgggaggctgaggcaggagaatggcgtgaacccaggaggcagaggttgcagtgagccgagatcatgctactgcactccagcctgggcgacagagcgagactctgtgtataaataaataaataaataaataaataacgaaaaggttgccattgccctttctggggaaagtgataatgaggaaagactagtttcttaacccaagtcagctttagagtcggcaaggatgcaatttgaggtgatccaggaaaactctattagcatggtatttcccatacagattcatttcttttaggcctgaagtctttttggcacttcttaataaaatcacagatacctcttggaaaaaagcttatcctttatcaatttctatcagttaaccactcagatgaggataaaggcctgagtcagaaaggacagagagaggttccacaaagagataaaagatgagtggccataaggagtccttgaaaacacacctctctagcccatcaaaaaatgcagcaccttaaactcaagtccatcttactagcctttagcagtaccccaccactctcaaaatttccagcattaaatgtctcggagctatataaaaggcagacttaggtataagtaggaagagatatcaagggcttgggtatcatttcagcactaatggagcttatggcatgtatgaatgaacctgatgcgtggtctccacggtagattgttacaattgaggtcccacatttatgagattcccagtgaaaacaaatctcacagcttcacctgagagaaacattactgtcagtctcagatacaaaagcctgctgctattaggtacctatacacctgctgaaaatggaccagctttgctgtagtagtgcgcgcaggcaaa

SEQ ID NO: 373589 - DNA, 2103 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgaggtgcgttccccagcctggtttgctctgggctctgacccgccgccgcgaatctccgctcgtaactccgggcctgaacctggaggagggaggatttcctctgtgcagctttcgagcggtagactcaccctgccaggcagacctagattggcataaccagagatcagttccagttgtgatgcagtgggtgtctacacacttctgatgacacctttattttaaaagctgatgttccaaggtgcaagcggtcttctctgtcttctttatggccagtaaaattctccagaagagatttatggcagcctcactcccagtagtttctgcatttagtgagataaggaatggattttcttctgtgtattgctgacacgaacaggagacggaaatactgagtagaagagggcggttccctggctaaggccccaccctcaagcctggatacccgcggccctaaatgagaagaggcgtttctgtttggggcccaaaaagttgccttttgacccaccacgccccctatcctgcccccatataaaccccaaaccccaacctccagagcataccagcaggtgaggagatacgaggcaagccgactgacggcaaaacgacgtagcagagaaagagagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtacgtgtgtgacccgatttttcctggattctggaaaagagctcggaatacagaaagctgtcccctggtcctttgcccttgtgaaaaagcagaaggtccattgagctggttaacactccagctgtctgtggtggccaagctgaaagagctttgtaacactggggttgcaggcacccacctctagacgctaccgcagagccagagcccaaagccctcaccccggcctctgcacttgcccatctgcgtgctccccctctcgcaaggggtttctgcagagggggctactgaacagatggaatcttgctctcttgctcagactggagtgcagtggcatgaccttggctcactgcaacctcacctctcgggttcaagcgattctgcctcagcctctcgagtagctgggactacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagataccctgagaataaaatctggatccagtgagaggaaagattctgggtgctcatgaaaaaagaaacaaaacaaaacttgggagcctcttgagagtgtacagcatcagcccttgccaactcttgtttatatgcatttaactttcagttaaccatgggaataattcatgaaaatccaatctacaaacaaaggccatcctaacgttcatgttattcttttccctaagaatctttcacaagagctataatcaagtagaattatgctttgatttgaattctaattcaattgaaaataaaggtagatgcgcgcgcttcctttagggagggttaattatcgatccccggtaatgattccgtggcttaggccg

SEQ ID NO: 373590 - DNA, 1735 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgaggtgcgttccccagcctggtttgctctgggctctgacccgccgccgcgaatctccgctcgtaactccgggcctgaacctggaggagggaggatttcctctgtgcagctttcgagcggtagactcaccctgccaggcagacctagattggcataaccagagatcagttccagttgtgatgcagtgggtgtctacacacttctgatgacacctttattttaaaagctgatgttccaaggtgcaagcggtcttctctgtcttctttatggccagtaaaattctccagaagagatttatggcagcctcactcccagtagtttctgcatttagtgagataaggaatggattttcttctgtgtattgctgacacgaacaggagacggaaatactgagtagaagagggcggttccctggctaaggccccaccctcaagcctggatacccgcggccctaaatgagaagaggcgtttctgtttggggcccaaaaagttgccttttgacccaccacgccccctatcctgcccccatataaaccccaaaccccaacctccagagcataccagcaggtgaggagatacgaggcaagccgactgacggcaaaacgacgtagcagagaaagagagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtacgtgtgtgacccgatttttcctggattctggaaaagagctcggaatacagaaagctgtcccctggtcctttgcccttgtgaaaaagcagaaggtccattgagctggttaacactccagctgtctgtggtggccaagctgaaagagctttgtaacactggggttgcaggcacccacctctagacgctaccgcagagccagagcccaaagccctcaccccggcctctgcacttgcccatctgcgtgctccccctctcgcaaggggtttctgcagagggggctactgaacaggtgagccacacccctgtcgcacgccctgcaaggggaatcagggaactcttccgtttcattgctttgaccacatcctataaatcttgttctccttgtctttcagctccaatttgtttatacattcagtttttacttttgactttactcatgatttattatagaaagatgtttaacaattttcaagcaaatggaataatttttgctcctctttcgttgttaatttattattcattggagttagaaaattgttgctaaaataaattctgcattttgaaatttaaaaaga

SEQ ID NO: 373591 - DNA, 1580 bp, Homo sapiens
cggcacgaggccgatccctactaaaaatacaaaaaattagctgggactacagagaccacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagataccctgagaataaaatctggatccagtgagaggaaagattctgggtgctcatgaaaaaagaaacaaaacaaaacttgggagcctcttgagagtgtacagcatcagcccttgccaactcttgtttatatgcatttaactttcagttaaccatgggaataattcatgaaaatccaatctacaaacaaaggccatcctaacgttcatgttattcttttccctaagaatctttcacaagagctataatcaagtagaattatgctttgatttgaattctaattcaattgaaaataaaaaatgagggccggacgcggtggctcatgcctgtaatcccagcgctttgggaggctgaggtggacggatcacgaggtcaggagatcgagaccatcctggctaacacggtgaaacccgatccctactaaaaatacaaaaaattagccgggcgtggtggcaggcgcctgtagtcccagctactcgggaggctgaggcaggagaatggcgtgaacccaggaggcagaggttgcagtgagccgagatcatgctactgcactccagcctgggcgacagagcgagactctgtgtataaataaataaataaataaataaataacgaaaaggttgccattgccctttctggggaaagtgataatgaggaaagactagtttcttaacccaagtcagctttagagtcggcaaggatgcaatttgaggtgatccaggaaaactctattagcatggtatttcccatacagattcatttcttttaggcctgaagtctttttggcacttcttaataaaatcacagatacctcttggaaaaaagcttatcctttatcaatttctatcagttaaccactcagatgaggataaaggcctgagtcagaaaggacagagagaggttccacaaagagataaaagatgagtggccataaggagtccttgaaaacacacctctctagcccatcaaaaaatgcagcaccttaaactcaagtccatcttactagcctttagcagtaccccaccactctcaaaatttccagcattaaatgtctcggagctatataaaaggcagacttaggtataagtaggaagagatatcaagggcttgggtatcatttcagcactaatggagcttatggcatgtatgaatgaacctgatgcgtggtctccacggtagattgttacaattgaggtcccacatttatgagattcccagtgaaaacaaatctcacagcttcacctgagagaaacattactgtcagtctcagatacaaaagcctgctgctattaggtacctatacacctgctgaaaatggaccagctttgctgtagtagtgcgcgcaggcaaa

SEQ ID NO: 373592 - DNA, 1810 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgaggtgcgttccccagcctggtttgctctgggctctgacccgccgccgcgaatctccgctcgtaactccgggcctgaacctggaggagggaggatttcctctgtgcagctttcgagcggtagactcaccctgccaggcagacctagattggcataaccagagatcagttccagttgtgatgcagtgggtgtctacacacttctgatgacacctttattttaaaagctgatgttccaaggtgcaagcggtcttctctgtcttctttatggccagtaaaattctccagaagagatttatggcagcctcactcccagtagtttctgcatttagtgagataaggaatggattttcttctgtgtattgctgacacgaacaggagacggaaatactgagtagaagagggcggttccctggctaaggccccaccctcaagcctggatacccgcggccctaaatgagaagaggcgtttctgtttggggcccaaaaagttgccttttgacccaccacgccccctatcctgcccccatataaaccccaaaccccaacctccagagcataccagcaggtgaggagatacgaggcaagccgactgacggcaaaacgacgtagcagagaaagagagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtacgtgtgtgacccgatttttcctggattctggaaaagagctcggaatacagaaagctgtcccctggtcctttgcccttgtgaaaaagcagaaggtccattgagctggttaacactccagctgtctgtggtggccaagctgaaagagctttgtaacactggggttgcaggcacccacctctagacgctaccgcagagccagagcccaaagccctcaccccggcctctgcacttgcccatctgcgtgctccccctctcgcaaggggtttctgcagagggggctactgaacagatggaatcttgctctcttgctcagactggagtgcagtggcatgaccttggctcactgcaacctcacctctcgggttcaagcgattctgcctcagcctctcgagtagctgggactacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagataccctgagaataaaaggtggatgcggccgaactccaatatactaccacccgtcgttgtatgacgacaccc

SEQ ID NO: 373593 - DNA, 1817 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgaggtgcgttccccagcctggtttgctctgggctctgacccgccgccgcgaatctccgctcgtaactccgggcctgaacctggaggagggaggatttcctctgtgcagctttcgagcggtagactcaccctgccaggcagacctagattggcataaccagagatcagttccagttgtgatgcagtgggtgtctacacacttctgatgacacctttattttaaaagctgatgttccaaggtgcaagcggtcttctctgtcttctttatggccagtaaaattctccagaagagatttatggcagcctcactcccagtagtttctgcatttagtgagataaggaatggattttcttctgtgtattgctgacacgaacaggagacggaaatactgagtagaagagggcggttccctggctaaggccccaccctcaagcctggatacccgcggccctaaatgagaagaggcgtttctgtttggggcccaaaaagttgccttttgacccaccacgccccctatcctgcccccatataaaccccaaaccccaacctccagagcataccagcaggtgaggagatacgaggcaagccgactgacggcaaaacgacgtagcagagaaagagagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtacgtgtgtgacccgatttttcctggattctggaaaagagctcggaatacagaaagctgtcccctggtcctttgcccttgtgaaaaagcagaaggtccattgagctggttaacactccagctgtctgtggtggccaagctgaaagagctttgtaacactggggttgcaggcacccacctctagacgctaccgcagagccagagcccaaagccctcaccccggcctctgcacttgcccatctgcgtgctccccctctcgcaaggggtttctgcagagggggctactgaacagatggaatcttgctctcttgctcagactggagtgcagtggcatgaccttggctcactgcaacctcacctctcgggttcaagcgattctgcctcagcctctcgagtagctgggactacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagataccctgagaatatgcccgatggcgtggtgctgggtgaacaatagcgatgaatggcgcgtttgtatataccatacccg

SEQ ID NO: 373594 - DNA, 957 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgaggtgcgttccccagcctggtttgctctgggctctgacccgccgccgcgaatctccgctcgtaactccgggcctgaacctggaggagggaggatttcctctgtgcagctttcgagcggtagactcaccctgccaggcagacctagattggcataaccagagatcagttccagttgtgatgcagtgggtgtctacacacttctgatgacacctttattttaaaagctgatgttccaaggtgcaagcggtcttctctgtcttctttatggccagtaaaattctccagaagagatttatggcagcctcactcccagtagtttctgcatttagtgagataagccacagcaattgtctgctattttaaaagcactgtgatgcttaaatattccagctgctacatcggacaggtgtctgatgatcctgagaacagtcatcaaaaagtagaacttgagcctggaatacattctctggcatagccatagtcaatcaccagtataattaatgtaaatggacactggatagcttttttgtgaattctgatgcagcacaaagagactttaattgtttccaaaaagaaaatgtctgagattaaaatctagagttttatgactta

SEQ ID NO: 373595 - DNA, 2851 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgaggtgcaagcggtcttctctgtcttctttatggccagtaaaattctccagaagagatttatggcagcctcactcccagtagtttctgcatttagtgagataaggaatggattttcttctgtgtattgctgacacgaacaggagacggaaatactgagtagaagagggcggttccctggctaaggccccaccctcaagcctggatacccgcggccctaaatgagaagaggcgtttctgtttggggcccaaaaagttgccttttgacccaccacgccccctatcctgcccccatataaaccccaaaccccaacctccagagcataccagcaggtgaggagatacgaggcaagccgactgacggcaaaacgacgtagcagagaaagagagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtacgtgtgtgacccgatttttcctggattctggaaaagagctcggaatacagaaagctgtcccctggtcctttgcccttgtgaaaaagcagaaggtccattgagctggttaacactccagctgtctgtggtggccaagctgaaagagctttgtaacactggggttgcaggcacccacctctagacgctaccgcagagccagagcccaaagccctcaccccggcctctgcacttgcccatctgcgtgctccccctctcgcaaggggtttctgcagagggggctactgaacagatggaatcttgctctcttgctcagactggagtgcagtggcatgaccttggctcactgcaacctcacctctcgggttcaagcgattctgcctcagcctctcgagtagctgggactacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagataccctgagaataaaatctggatccagtgagaggaaagattctgggtgctcatgaaaaaagaaacaaaacaaaacttgggagcctcttgagagtgtacagcatcagcccttgccaactcttgtttatatgcatttaactttcagttaaccatgggaataattcatgaaaatccaatctacaaacaaaggccatcctaacgttcatgttattcttttccctaagaatctttcacaagagctataatcaagtagaattatgctttgatttgaattctaattcaattgaaaataaaaaatgagggccggacgcggtggctcatgcctgtaatcccagcgctttgggaggctgaggtggacggatcacgaggtcaggagatcgagaccatcctggctaacacggtgaaacccgatccctactaaaaatacaaaaaattagccgggcgtggtggcaggcgcctgtagtcccagctactcgggaggctgaggcaggagaatggcgtgaacccaggaggcagaggttgcagtgagccgagatcatgctactgcactccagcctgggcgacagagcgagactctgtgtataaataaataaataaataaataaataacgaaaaggttgccattgccctttctggggaaagtgataatgaggaaagactagtttcttaacccaagtcagctttagagtcggcaaggatgcaatttgaggtgatccaggaaaactctattagcatggtatttcccatacagattcatttcttttaggcctgaagtctttttggcacttcttaataaaatcacagatacctcttggaaaaaagcttatcctttatcaatttctatcagttaaccactcagatgaggataaaggcctgagtcagaaaggacagagagaggttccacaaagagataaaagatgagtggccataaggagtccttgaaaacacacctctctagcccatcaaaaaatgcagcaccttaaactcaagtccatcttactagcctttagcagtaccccaccactctcaaaatttccagcattaaatgtctcggagctatataaaaggcagacttaggtataagtaggaagagatatcaagggcttgggtatcatttcagcactaatggagcttatggcatgtatgaatgaacctgatgcgtggtctccacggtagattgttacaattgaggtcccacatttatgagattcccagtgaaaacaaatctcacagcttcacctgagagaaacattactgtcagtctcagatacaaaagcctgctgctattaggtacctatacacctgctgaaaatggaccagctttgctgtagtagtgcgcgcaggcaaa

SEQ ID NO: 373596 - DNA, 3072 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgagagagtcggggtttcaccgtgttagccaggatggtctcgatctcctgacctcgtgatccgcccacctccgcctctccaagtgctgggattacaggcatgagccaccgcgcccggcccttgtatttttaaactttgactttatggagacgaacaccatcgtttgctgaacacttgaaacatgatgaaagagccacagagttggcagaactgtttgaaaatgctgtgcaagcggtcttctctgtcttctttatggccagtaaaattctccagaagagatttatggcagcctcactcccagtagtttctgcatttagtgagataaggaatggattttcttctgtgtattgctgacacgaacaggagacggaaatactgagtagaagagggcggttccctggctaaggccccaccctcaagcctggatacccgcggccctaaatgagaagaggcgtttctgtttggggcccaaaaagttgccttttgacccaccacgccccctatcctgcccccatataaaccccaaaccccaacctccagagcataccagcaggtgaggagatacgaggcaagccgactgacggcaaaacgacgtagcagagaaagagagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtacgtgtgtgacccgatttttcctggattctggaaaagagctcggaatacagaaagctgtcccctggtcctttgcccttgtgaaaaagcagaaggtccattgagctggttaacactccagctgtctgtggtggccaagctgaaagagctttgtaacactggggttgcaggcacccacctctagacgctaccgcagagccagagcccaaagccctcaccccggcctctgcacttgcccatctgcgtgctccccctctcgcaaggggtttctgcagagggggctactgaacagatggaatcttgctctcttgctcagactggagtgcagtggcatgaccttggctcactgcaacctcacctctcgggttcaagcgattctgcctcagcctctcgagtagctgggactacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagataccctgagaataaaatctggatccagtgagaggaaagattctgggtgctcatgaaaaaagaaacaaaacaaaacttgggagcctcttgagagtgtacagcatcagcccttgccaactcttgtttatatgcatttaactttcagttaaccatgggaataattcatgaaaatccaatctacaaacaaaggccatcctaacgttcatgttattcttttccctaagaatctttcacaagagctataatcaagtagaattatgctttgatttgaattctaattcaattgaaaataaaaaatgagggccggacgcggtggctcatgcctgtaatcccagcgctttgggaggctgaggtggacggatcacgaggtcaggagatcgagaccatcctggctaacacggtgaaacccgatccctactaaaaatacaaaaaattagccgggcgtggtggcaggcgcctgtagtcccagctactcgggaggctgaggcaggagaatggcgtgaacccaggaggcagaggttgcagtgagccgagatcatgctactgcactccagcctgggcgacagagcgagactctgtgtataaataaataaataaataaataaataacgaaaaggttgccattgccctttctggggaaagtgataatgaggaaagactagtttcttaacccaagtcagctttagagtcggcaaggatgcaatttgaggtgatccaggaaaactctattagcatggtatttcccatacagattcatttcttttaggcctgaagtctttttggcacttcttaataaaatcacagatacctcttggaaaaaagcttatcctttatcaatttctatcagttaaccactcagatgaggataaaggcctgagtcagaaaggacagagagaggttccacaaagagataaaagatgagtggccataaggagtccttgaaaacacacctctctagcccatcaaaaaatgcagcaccttaaactcaagtccatcttactagcctttagcagtaccccaccactctcaaaatttccagcattaaatgtctcggagctatataaaaggcagacttaggtataagtaggaagagatatcaagggcttgggtatcatttcagcactaatggagcttatggcatgtatgaatgaacctgatgcgtggtctccacggtagattgttacaattgaggtcccacatttatgagattcccagtgaaaacaaatctcacagcttcacctgagagaaacattactgtcagtctcagatacaaaagcctgctgctattaggtacctatacacctgctgaaaatggaccagctttgctgtagtagtgcgcgcaggcaaa

SEQ ID NO: 373597 - DNA, 2306 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgagagagtcggggtttcaccgtgttagccaggatggtctcgatctcctgacctcgtgatccgcccacctccgcctctccaagtgctgggattacaggcatgagccaccgcgcccggcccttgtatttttaaactttgactttatggagacgaacaccatcgtttgctgaacacttgaaacatgatgaaagagccacagagttggcagaactgtttgaaaatgctgtgcaagcggtcttctctgtcttctttatggccagtaaaattctccagaagagatttatggcagcctcactcccagtagtttctgcatttagtgagataagatggaatcttgctctcttgctcagactggagtgcagtggcatgaccttggctcactgcaacctcacctctcgggttcaagcgattctgcctcagcctctcgagtagctgggactacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagataccctgagaataaaatctggatccagtgagaggaaagattctgggtgctcatgaaaaaagaaacaaaacaaaacttgggagcctcttgagagtgtacagcatcagcccttgccaactcttgtttatatgcatttaactttcagttaaccatgggaataattcatgaaaatccaatctacaaacaaaggccatcctaacgttcatgttattcttttccctaagaatctttcacaagagctataatcaagtagaattatgctttgatttgaattctaattcaattgaaaataaaaaatgagggccggacgcggtggctcatgcctgtaatcccagcgctttgggaggctgaggtggacggatcacgaggtcaggagatcgagaccatcctggctaacacggtgaaacccgatccctactaaaaatacaaaaaattagccgggcgtggtggcaggcgcctgtagtcccagctactcgggaggctgaggcaggagaatggcgtgaacccaggaggcagaggttgcagtgagccgagatcatgctactgcactccagcctgggcgacagagcgagactctgtgtataaataaataaataaataaataaataacgaaaaggttgccattgccctttctggggaaagtgataatgaggaaagactagtttcttaacccaagtcagctttagagtcggcaaggatgcaatttgaggtgatccaggaaaactctattagcatggtatttcccatacagattcatttcttttaggcctgaagtctttttggcacttcttaataaaatcacagatacctcttggaaaaaagcttatcctttatcaatttctatcagttaaccactcagatgaggataaaggcctgagtcagaaaggacagagagaggttccacaaagagataaaagatgagtggccataaggagtccttgaaaacacacctctctagcccatcaaaaaatgcagcaccttaaactcaagtccatcttactagcctttagcagtaccccaccactctcaaaatttccagcattaaatgtctcggagctatataaaaggcagacttaggtataagtaggaagagatatcaagggcttgggtatcatttcagcactaatggagcttatggcatgtatgaatgaacctgatgcgtggtctccacggtagattgttacaattgaggtcccacatttatgagattcccagtgaaaacaaatctcacagcttcacctgagagaaacattactgtcagtctcagatacaaaagcctgctgctattaggtacctatacacctgctgaaaatggaccagctttgctgtagtagtgcgcgcaggcaaa

SEQ ID NO: 373598 - DNA, 2320 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgaggtgcgttccccagcctggtttgctctgggctctgacccgccgccgcgaatctccgctcgtaactccgggcctgaacctggaggagggaggatttcctctgtgcagctttcgagcggtagactcaccctgccaggcagacctagattggcataaccagagatcagttccagttgtgatgcagtgggtgtctacacacttctgatgacacctttattttaaaagctgatgttccaaggtgcaagcggtcttctctgtcttctttatggccagtaaaattctccagaagagatttatggcagcctcactcccagtagtttctgcatttagtgagataagatggaatcttgctctcttgctcagactggagtgcagtggcatgaccttggctcactgcaacctcacctctcgggttcaagcgattctgcctcagcctctcgagtagctgggactacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagataccctgagaataaaatctggatccagtgagaggaaagattctgggtgctcatgaaaaaagaaacaaaacaaaacttgggagcctcttgagagtgtacagcatcagcccttgccaactcttgtttatatgcatttaactttcagttaaccatgggaataattcatgaaaatccaatctacaaacaaaggccatcctaacgttcatgttattcttttccctaagaatctttcacaagagctataatcaagtagaattatgctttgatttgaattctaattcaattgaaaataaaaaatgagggccggacgcggtggctcatgcctgtaatcccagcgctttgggaggctgaggtggacggatcacgaggtcaggagatcgagaccatcctggctaacacggtgaaacccgatccctactaaaaatacaaaaaattagccgggcgtggtggcaggcgcctgtagtcccagctactcgggaggctgaggcaggagaatggcgtgaacccaggaggcagaggttgcagtgagccgagatcatgctactgcactccagcctgggcgacagagcgagactctgtgtataaataaataaataaataaataaataacgaaaaggttgccattgccctttctggggaaagtgataatgaggaaagactagtttcttaacccaagtcagctttagagtcggcaaggatgcaatttgaggtgatccaggaaaactctattagcatggtatttcccatacagattcatttcttttaggcctgaagtctttttggcacttcttaataaaatcacagatacctcttggaaaaaagcttatcctttatcaatttctatcagttaaccactcagatgaggataaaggcctgagtcagaaaggacagagagaggttccacaaagagataaaagatgagtggccataaggagtccttgaaaacacacctctctagcccatcaaaaaatgcagcaccttaaactcaagtccatcttactagcctttagcagtaccccaccactctcaaaatttccagcattaaatgtctcggagctatataaaaggcagacttaggtataagtaggaagagatatcaagggcttgggtatcatttcagcactaatggagcttatggcatgtatgaatgaacctgatgcgtggtctccacggtagattgttacaattgaggtcccacatttatgagattcccagtgaaaacaaatctcacagcttcacctgagagaaacattactgtcagtctcagatacaaaagcctgctgctattaggtacctatacacctgctgaaaatggaccagctttgctgtagtagtgcgcgcaggcaaa

SEQ ID NO: 373599 - DNA, 2661 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgaggtgcgttccccagcctggtttgctctgggctctgacccgccgccgcgaatctccgctcgtaactccgggcctgaacctggaggagggaggatttcctctgtgcagctttcgagcggtagactcaccctgccaggcagacctagattggcataaccagagatcagttccagttgtgatgcagtgggtgtctacacacttctgatgacacctttattttaaaagctgatgttccaaggtgcaagcggtcttctctgtcttctttatggccagtaaaattctccagaagagatttatggcagcctcactcccagtagtttctgcatttagtgagataaggaatggattttcttctgtgtattgctgacacgaacaggagacggaaatactgagtagaagagggcggttccctggctaaggccccaccctcaagcctggatacccgcggccctaaatgagaagaggcgtttctgtttggggcccaaaaagttgccttttgacccaccacgccccctatcctgcccccatataaaccccaaaccccaacctccagagcataccagcaggtgaggagatacgaggcaagccgactgacggcaaaacgacgtagcagagaaagagagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtacgtgtgtgacccgatttttcctggattctggaaaagagctcggaatacagaaagctgtcccctggtcctttgcccttgtgaaaaagcagaaggtccattgagctggttaacactccagctgtctgtggtggccaagctgaaagagctttgtaacactggggttgcaggcacccacctctagacgctaccgcagagccagagcccaaagccctcaccccggcctctgcacttgcccatctgcgtgctccccctctcgcaaggggtttctgcagagggggctactgaacagatggaatcttgctctcttgctcagactggagtgcagtggcatgaccttggctcactgcaacctcacctctcgggttcaagcgattctgcctcagcctctcgagtagctgggactacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagataccctgagaataaaatctggatccagtgagaggaaagattctgggtgctcatgaaaaaagaaacaaaacaaaacttgggagcctcttgagagtgtacagcatcagcccttgccaactcttgtttatatgcatttaactttcagttaaccatgggaataattcataaataaataaataaataacgaaaaggttgccattgccctttctggggaaagtgataatgaggaaagactagtttcttaacccaagtcagctttagagtcggcaaggatgcaatttgaggtgatccaggaaaactctattagcatggtatttcccatacagattcatttcttttaggcctgaagtctttttggcacttcttaataaaatcacagatacctcttggaaaaaagcttatcctttatcaatttctatcagttaaccactcagatgaggataaaggcctgagtcagaaaggacagagagaggttccacaaagagataaaagatgagtggccataaggagtccttgaaaacacacctctctagcccatcaaaaaatgcagcaccttaaactcaagtccatcttactagcctttagcagtaccccaccactctcaaaatttccagcattaaatgtctcggagctatataaaaggcagacttaggtataagtaggaagagatatcaagggcttgggtatcatttcagcactaatggagcttatggcatgtatgaatgaacctgatgcgtggtctccacggtagattgttacaattgaggtcccacatttatgagattcccagtgaaaacaaatctcacagcttcacctgagagaaacattactgtcagtctcagatacaaaagcctgctgctattaggtacctatacacctgctgaaaatggaccagctttgctgtagtagtgcgcgcaggcaaa

SEQ ID NO: 373600 - DNA, 2309 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgaggtgcgttccccagcctggtttgctctgggctctgacccgccgccgcgaatctccgctcgtaactccgggcctgaacctggaggagggaggatttcctctgtgcagctttcgagcggtagactcaccctgccaggcagacctagattggcataaccagagatcagttccagttgtgatgcagtgggtgtctacacacttctgatgacacctttattttaaaagctgatgttccaaggtgcaagcggtcttctctgtcttctttatggccagtaaaattctccagaagagatttatggcagcctcactcccagtagtttctgcatttagtgagataaggaatggattttcttctgtgtattgctgacacgaacaggagacggaaatactgagtagaagagggcggttccctggctaaggccccaccctcaagcctggatacccgcggccctaaatgagaagaggcgtttctgtttggggcccaaaaagttgccttttgacccaccacgccccctatcctgcccccatataaaccccaaaccccaacctccagagcataccagcaggtgaggagatacgaggcaagccgactgacggcaaaacgacgtagcagagaaagagagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtacgtgtgtgacccgatttttcctggattctggaaaagagctcggaatacagaaagctgtcccctggtcctttgcccttgtgaaaaagcagaaggtccattgagctggttaacactccagctgtctgtggtggccaagctgaaagagctttgtaacactggggttgcaggcacccacctctagacgctaccgcagagccagagcccaaagccctcaccccggcctctgcacttgcccatctgcgtgctccccctctcgcaaggggtttctgcagagggggctactgaacagatggaatcttgctctcttgctcagactggagttgcagtgagccgagatcatgctactgcactccagcctgggcgacagagcgagactctgtgtataaataaataaataaataaataaataacgaaaaggttgccattgccctttctggggaaagtgataatgaggaaagactagtttcttaacccaagtcagctttagagtcggcaaggatgcaatttgaggtgatccaggaaaactctattagcatggtatttcccatacagattcatttcttttaggcctgaagtctttttggcacttcttaataaaatcacagatacctcttggaaaaaagcttatcctttatcaatttctatcagttaaccactcagatgaggataaaggcctgagtcagaaaggacagagagaggttccacaaagagataaaagatgagtggccataaggagtccttgaaaacacacctctctagcccatcaaaaaatgcagcaccttaaactcaagtccatcttactagcctttagcagtaccccaccactctcaaaatttccagcattaaatgtctcggagctatataaaaggcagacttaggtataagtaggaagagatatcaagggcttgggtatcatttcagcactaatggagcttatggcatgtatgaatgaacctgatgcgtggtctccacggtagattgttacaattgaggtcccacatttatgagattcccagtgaaaacaaatctcacagcttcacctgagagaaacattactgtcagtctcagatacaaaagcctgctgctattaggtacctatacacctgctgaaaatggaccagctttgctgtagtagtgcgcgcaggcaaa

SEQ ID NO: 373601 - DNA, 1810 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgaggtgcgttccccagcctggtttgctctgggctctgacccgccgccgcgaatctccgctcgtaactccgggcctgaacctggaggagggaggatttcctctgtgcagctttcgagcggtagactcaccctgccaggcagacctagattggcataaccagagatcagttccagttgtgatgcagtgggtgtctacacacttctgatgacacctttattttaaaagctgatgttccaaggtgcaagcggtcttctctgtcttctttatggccagtaaaattctccagaagagatttatggcagcctcactcccagtagtttctgcatttagtgagataaggaatggattttcttctgtgtattgctgacacgaacaggagacggaaatactgagtagaagagggcggttccctggctaaggccccaccctcaagcctggatacccgcggccctaaatgagaagaggcgtttctgtttggggcccaaaaagttgccttttgacccaccacgccccctatcctgcccccatataaaccccaaaccccaacctccagagcataccagcaggtgaggagatacgaggcaagccgactgacggcaaaacgacgtagcagagaaagagagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtacgtgtgtgacccgatttttcctggattctggaaaagagctcggaatacagaaagctgtcccctggtcctttgcccttgtgaaaaagcagaaggtccattgagctggttaacactccagctgtctgtggtggccaagctgaaagagctttgtaacactggggttgcaggcacccacctctagacgctaccgcagagccagagcccaaagccctcaccccggcctctgcacttgcccatctgcgtgctccccctctcgcaaggggtttctgcagagggggctactgaacagatggaatcttgctctcttgctcagactggagtgcagtggcatgaccttggctcactgcaacctcacctctcgggttcaagcgattctgcctcagcctctcgagtagctgggactacaggtgggagacctccacagaacccttccagcaagctgtcttctaaagcaaacaagaaaaggaaagtctgagcagttttgattagatttcccagaagtcaaagcaaggaaaaatgaaaaagcttcatttctcacgttcttaaaagagagcacagatgttgcatcatctggttagataccctgagaatatcggagtgcggccgaataaaggcaaaccgaataagcggtgattacataggtggagtag

SEQ ID NO: 373602 - DNA, 1325 bp, Homo sapiens
cgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggcttttttttttccccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgaggtgcgttccccagcctggtttgctctgggctctgacccgccgccgcgaatctccgctcgtaactccgggcctgaacctggaggagggaggatttcctctgtgcagctttcgagcggtagactcaccctgccaggcagacctagattggcataaccagagatcagttccagttgtgatgcagtgggtgtctacacacttctgatgacacctttattttaaaagctgatgttccaagagagtcggggtttcaccgtgttagccaggatggtctcgatctcctgacctcgtgatccgcccacctccgcctctccaagtgctgggattacaggcatgagccaccgcgcccggcccttgtatttttaaactttgactttatggagacgaacaccatcgtttgctgaacacttgaaacatgatgaaagagccacagagttggcagaactgtttgaaaatgctatttttagggcagtttttagtgtcattatgttgctgctacatatttggaagatggaacaagcccagacaaaggaggattcttttttactcatcttaaatccattttattttccttcatctgagccccttaaaactaatgtgttactggtgcaagcggtcttctctgtcttctttatggccagtaaaattctccagaagagatttatggcagcctcactcccagtagtttctgcatttagtgagataagccacagcaattgtctgctattttaaaagcactgtgatgcttaaatattccagctgctacatcggacaggtgtctgatgatcctgagaacagtcatcaaaaagtagaacttgagcctggaatacattctctggcatagccatagtcaatcaccagtataattaatgtaaatggacactggatagcttttttgtgaattctgatgcagcacaaagagactttaattgtttccaaaaagaaaatgtctgagattaaaatctagagttttatgactta

SEQ ID NO: 373603 - DNA, 439 bp, Homo sapiens
gagcagaagggcctgacgtaccaccgcatcgtagaggctttccggtttgcctacgccaagaggaccctgcttggggaccccaagtttgtggatgtgactgaggccagctctggggtctcagcaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctactttggctccaaggtctgctccccggtcagtgggatcctgttcaataatgaatggacgacttcagctctcccagcatcaccaatgagtttggggcacccccctcacctgccaatttcatccagccag

SEQ ID NO: 373604 - DNA, 242 bp, Homo sapiens
acttatatgccgatttaaatcgttctctaagaaaaggtggtatttcctctcactgcaggttctaccagactctcatcacctgcttgccaagcagcagccaagggaaaacagtttgaaatttactgctaacaattggttcacatacataccgggtacgggggactcttgcctgtagtcccagctactcaggaggctgaggctggaggaatgcttgagtccaggagttcaagtccagcccaggt

SEQ ID NO: 373605 - DNA, 3089 bp, Homo sapiens
  misc_feature (497)..(497): n is a, c, g, or t
cgtgtctacctctgccttctgtggacaccatgcgccttggtccttgtgtcatggtgtatttacactgccgtactcacccataactgcgtgctccttacaaaaccccatccaagccagagccgtctcgatgccaaccccctctcctcccttcaggcctgtgcagagggaatttttcatggtgcctgttttgatgatttttttctccatctaactgaagtcctttggcatgggccaagctttcttcatggtggcttggtttggaactgtttccttgctttactgggatcccctggtggaaaggggtggggggttggggcggtaaagggtgctgatgatttgccacaggagggaaaaaaccttcctttccttgatttgcagctctaatcctcatccttagccccatccctatctgccatggtgggtcggggagagccctgaggagccttttggttcccaagtccatcttgatgttcactcttcccctcactcctgagagnccttctgccatcttggtccccagacccggccttgccactcagtgtccctaccactcgagaccctggctccaaaacgccactcatcccacagcaaatcatgttggtcgtgctccgttgtgtacccatctagtgaaggcacagtgttgctgagttgcatgactcatctcattctcttctgggacatactgacattttgcaaacatgcatgctttgcaaggaaagctgcagaactcattttcatactgtaacctgatgccatgtcacccgtgacccgttcagtaggagagaatagactgtcgcttgctgtctttcgtttcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccagggctctaagacacggccgcgctctgatgtgttgttttttaaggagacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcca

SEQ ID NO: 373606 - DNA, 1570 bp, Homo sapiens
taaagccaaaataatgaaacactttatttatatcatgttaaactctctacgacagtgccatagacattaaagggacacagtaaggaaaacactccctggaggaagggaaagcaggtctcaaaatctgctttcacagagcagcaaacattcatttctacaaggcccaaatgtaaagcctgcaaatgaagtcaacaaattagtgtaatgatacaaagcattcgtctgagaaaatggcaaattatagccaaccaacaggctctgaagtacacattgaatgacaaaaggtataggaccaacagttaaggcatttagacacccaacagaggaaacaaatgcaaaaacatccattgtacagttaacaggaactgttcgcggctggtatcaccactccttatgtgcttcccatagaggaaacccaccaccagtttaccagtggctggccctacaagtgaataggatcctcggaattaaaaaacaaacaaacaaacaaacaaaaaacctccctgactccaaagcaacaaaaatggcactacgatcatacatcacagacaatgcacatcttaagagctgccactggagccaaaattccagcaagtttgagagctataaagaataagtggcacgtgttttcacactgtagtatatcacactccacagggaagcagcagtgcctaaaagatgtgaattttacatgagtacacttccaaggaacatattccacgtgtttggggaaagcagtcacagacaggaggtgatcacagtacccactagagctcatgaacctgagatgggacatgggaataacagattatgcatcttattttccatctgtcattgctgctgttgtgtaaaggctcatgcagacccatctaagctgaggagatgggatctaaaggtacagcagaagacaaccctaacttcaccgcccctccattctgctgcgactcagctcacaaagcagattctcacagaagcaagtcctggggcaggagcaatactggcccgctaggcaagcagaagacttgcgtgccagtccaagctttgccatgagtagttttatgaccttgaataggtgaatttgcccccgtgggctttaatttacacagatatgaaaggtggagttgaactttgatgtgagaggtttacaaacttactgtgtctgtaggggtgttctggacattgtggtgggaggtaagggggtatcacaagggggccccatttaaatcacagcagccgtgcatgtcaggttgcacctgatagattctgcagttttaaaatatttttctttaaatttttaaactgtttgaagtgcatggtcactgtcagcactggacttggactgcctgtgttcagctcaatcacctactccccacgtgaccttcagcaagtttgcttagaccgtgtctagttccacaaccagaaaataaggaaatagcagttattataataaggattaaatgtgaatgtctgaggcactgagaactgtgtctggcacagatattatctttagatactaaataatgtgtttttatctttttaaaagattttcagcaacttaaaaaaaaatgtg

SEQ ID NO: 373607 - DNA, 4437 bp, Homo sapiens
  misc_feature (7)..(7): n is a, c, g, or t
  misc_feature (15)..(15): n is a, c, g, or t
gcatttnatgccccntttgactctagaccatcccacctttttagtgctccctgggggccaggagcgcttcagcctctaccaaaccagaagtctgatccatgagctgaagaataaagaaattcattttcaaaggaaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcca

SEQ ID NO: 373608 - DNA, 4506 bp, Homo sapiens
  misc_feature (7)..(7): n is a, c, g, or t
  misc_feature (15)..(15): n is a, c, g, or t
gcatttnatgccccntttgactctagaccatcccacctttttagtgctccctgggggccaggagcgcttcagcctctaccaaaccagaagtctgatccatgagctgaagaataaagaaattcattttcaaaggaaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcca

SEQ ID NO: 373609 - DNA, 4290 bp, Homo sapiens
ctggaactgcttatcatctctgccagctggggctccatgtctttccagctgtcctgaagttgactaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcca

SEQ ID NO: 373610 - DNA, 3407 bp, Homo sapiens
gcgagcctgggggctgctgaaatgacttcctctaagtagccagcttcccctcacctctggcaagggctgcctaaaccacagcctgcccccagctgctgagacagctttgcaagacattgctgatgtactccagctgctatgtaatgaacttgaaagcctgttctgtagctggcatcaggactggtgaattaggccctctgctgccattgcagtttggggatgaacccctggcagcaggtcgcttgggatgtagaagggaaggagggcgtcctggcactctgcatgctttggctctgacccctcccatgtgatgcaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcca

SEQ ID NO: 373611 - DNA, 1501 bp, Homo sapiens
ttttttttttatcattgataggactaaactgtcttcaacttactaactggagtttctttacccagcagttcagagcagtgagaactacagaaggcgaggaggagacagagagcaggtaacggggctttaccgtgacagcagtgcgttcccctgctccacactcccactgactcagtcttgccaatgccactatcaaggtccttgcaaaaatctggttttcttttgtctggaaagggctggttttctcctctgaaactgaaccccaactgttggccctatttaaatctcaggtcttggatttcttacttacataagcaggggcttaggtaatagagtgggttgtgcctgtggagcctcccaatcagctctcaacctcctctgttggcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcca

SEQ ID NO: 373612 - DNA, 4779 bp, Homo sapiens
  misc_feature (7)..(7): n is a, c, g, or t
  misc_feature (15)..(15): n is a, c, g, or t
  misc_feature (4779)..(4779): n is a, c, g, or t
gcatttnatgccccntttgactctagaccatcccacctttttagtgctccctgggggccaggagcgcttcagcctctaccaaaccagaagtctgatccatgagctgaagaataaagaaattcattttcaaaggaaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccaaaaaaaaaacacatcaaactcaaagcagcacatatgaacgaaaaagaagaacgagagccgacagcagaagataagaaaaagaaacgaagacgagggaccgcacaaacaacgagcgaaacaacaaagccagcatgagagagaaccacagaagcataaaaagagggaaccaagaggacgagaaagcacagaacacgccgggcagacaccagtgcgcagaagaagaacgaggagagggaaaaacagaaaaaaaaagaataatacaccgaagatacn

SEQ ID NO: 373613 - DNA, 1037 bp, Homo sapiens
gatcctggtgctaacggtctgtggtttttactgtcctcctgtgttaaacgatacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcca

SEQ ID NO: 373614 - DNA, 4349 bp, Homo sapiens
  misc_feature (7)..(7): n is a, c, g, or t
  misc_feature (15)..(15): n is a, c, g, or t
gcatttnatgccccntttgactctagaccatcccacctttttagtgctccctgggggccaggagcgcttcagcctctaccaaaccagaagtctgatccatgagctgaagaataaagaaattcattttcaaaggaaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggccaccgagttgattagagggtcactgctccatcgttgcttcaggcaaaagagtctccatcttcattccaaatgaggtgagtgtttgagaggccttttctgcccttaagtagagatgcgggacaagtcaaagttgcagtgaaaggaagtgtggtctgcatttcaaagcttaatattgtgcatgtcaatttttgtctcttcctcaggataagggcctttaagctggtttgctccccatctccagggaggccactgcagcttctttcactcaaagctcagtgtattcccaaaactcttttatgaggtagtctgggttttatatcgtctgcaaatctttcattgcccacatgcaagggacattttcacatgactcttggcactaagataacttcaaatgaatgaattgcttttctccccatctgtaaaggatataattctaatcaaactcagaatgattacagaaaatctatccaaataatcgatgcactggataccaggacttttgtgagctgcattttacttgtatacacaggacctgtggtcataaatcaatcacaagtgtgagattagctgactaaagatgaaattgttctttttaagaagatacattaaagcagagcttcttaactcttctgaaattgtactcaagcatttgtgttcaggtgccctttcccaggaagactagccctggttttcatcaaattctcaaaggactctctaaccccacaataagaattcagaatagaatgtagacactacttagcctaattactgtaa

SEQ ID NO: 373615 - DNA, 3443 bp, Homo sapiens
  misc_feature (7)..(7): n is a, c, g, or t
  misc_feature (15)..(15): n is a, c, g, or t
gcatttnatgccccntttgactctagaccatcccacctttttagtgctccctgggggccaggagcgcttcagcctctaccaaaccagaagtctgatccatgagctgaagaataaagaaattcattttcaaaggaaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagttcagagcagtaagaactgtattgtatgtttctgcaggattatagagccttagaaacaaagaatgtatgtgtaccacgtgtgttgaggtaatctgaggg

SEQ ID NO: 373616 - DNA, 2634 bp, Homo sapiens
  misc_feature (7)..(7): n is a, c, g, or t
  misc_feature (15)..(15): n is a, c, g, or t
  misc_feature (2493)..(2493): n is a, c, g, or t
gcatttnatgccccntttgactctagaccatcccacctttttagtgctccctgggggccaggagcgcttcagcctctaccaaaccagaagtctgatccatgagctgaagaataaagaaattcattttcaaaggaaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgaacctatgatcataggttcgcagggggagtggtaaggagaggatggtttgggctccttcctctttttagaaatatacaagcagaaatctcattctctcaagtngttataaaatgtgcaaaatacaagcctcctttgcccagaggcaccatttacatctggtattcacctttgctaagagatagagatctatatatactccacgtgctcacgcacgcgtgcactcgcagccaagctcacacaatt

SEQ ID NO: 373617 - DNA, 724 bp, Homo sapiens
  misc_feature (7)..(7): n is a, c, g, or t
  misc_feature (15)..(15): n is a, c, g, or t
gcatttnatgccccntttgactctagaccatcccacctttttagtgctccctgggggccaggagcgcttcagcctctaccaaaccagaagtctgatccatgagctgaagaataaagaaattcattttcaaaggaaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtaagtcagctcactgcagggcacggctgtttgggagtggattgaaatgtctctgaaggccagacaaagtagaaaggagcttaatttcattgaaccggaggcccttttcagtgggacccctggcccggccgctgctc

SEQ ID NO: 373618 - DNA, 423 bp, Homo sapiens
ttttttaaccaccctgacccctaattagctggaggcagagaaatctgttgcattattgctttttttaattggcgattttttaattccaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggtgagttagaggtgtggtggggaagagggattcagaatgtgcatgtgaacgcattgctatgctggacgagcagatcccatgtattcgtggcataggcgcagcttgcagatggtgtatgtagaggtcactct

SEQ ID NO: 373619 - DNA, 444 bp, Homo sapiens
aagccctaccttcatagtggcacttttattcgcggcctcctggcactgtgctgagtgtcttccttctttcctcttcctcattttggggccctggcatttagtttaaagctggtcctcgtattcagtgggtaaggccagaaaagcaaatgactgtgatggattggaagcagtaagccatgttcctggcacaccctcttccagggctctaagacacggccgcgctctgatgtgttgttttttaaggagacttccaccagttgagtcaaaatctgctgctgtggttagcgagtgccaagaaccggaggcagaaggctcatgtcaccgatccaaaggcagacccccgggctctcctagagtgtcggagggaactaatggtaagtttcctcccaagggctctgtactgccaccagcctctgtcagccccagagaggcagcacactcagg

SEQ ID NO: 373620 - DNA, 1552 bp, Homo sapiens
  misc_feature (497)..(497): n is a, c, g, or t
cgtgtctacctctgccttctgtggacaccatgcgccttggtccttgtgtcatggtgtatttacactgccgtactcacccataactgcgtgctccttacaaaaccccatccaagccagagccgtctcgatgccaaccccctctcctcccttcaggcctgtgcagagggaatttttcatggtgcctgttttgatgatttttttctccatctaactgaagtcctttggcatgggccaagctttcttcatggtggcttggtttggaactgtttccttgctttactgggatcccctggtggaaaggggtggggggttggggcggtaaagggtgctgatgatttgccacaggagggaaaaaaccttcctttccttgatttgcagctctaatcctcatccttagccccatccctatctgccatggtgggtcggggagagccctgaggagccttttggttcccaagtccatcttgatgttcactcttcccctcactcctgagagnccttctgccatcttggtccccagacccggccttgccactcagtgtccctaccactcgagaccctggctccaaaacgccactcatcccacagcaaatcatgttggtcgtgctccgttgtgtacccatctagtgaaggcacagtgttgctgagttgcatgactcatctcattctcttctgggacatactgacattttgcaaacatgcatgctttgcaaggaaagctgcagaactcattttcatactgtaacctgatgccatgtcacccgtgacccgttcagtaggagagaatagactgtcgcttgctgtctttcgtttcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatgtaagtcttaacttcactgggagtacagcctatgtctgtgagtcatacttacatttgcaagagagagagattttggtgtaaactgcgtgtattcattccccaggcatattttgagttggttttcttatggtgacagtgtctctgttgagctgtccatacttcattagaaccccggcaaaaccgattagacttagagataggttctggccaaaaaccatctttctgtatgttggtgtggtgtaacagtcattattactgtcgagtcaggtgtctgtgcaaatagtgagcaagcaaggtgctggctttcctgactgctcctgagctctcaagcctttgtctttttgttgttgttgtggagacggagtctcattctgtcacccaggctggagtgcactggcacgatcttgacttactgcaatctctgcctcctgggttcaagtgattttcctgcctcagcctcccaagtagctgcgattacaggtgtgcaccaccatgcctggctaatttttgtatttttagtagagatgggggtttcaccatgttggccaggctggtcttgaactcctgacctcaagtgatccacctgcctcagcctc

SEQ ID NO: 373621 - DNA, 3548 bp, Homo sapiens
gtttatttcttccatgcagtccttctgtaacttttcaatcatttcttcaatactaatgtccgctgtctgtagaactttgtttaccatctgcaccagccaggcacacaactctttatttttttcattgaatacaacccatgtattgagtctgtcttcaatctcctgtttacgtatggccacccttaagcagaggtcctccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcca

SEQ ID NO: 373622 - DNA, 2626 bp, Homo sapiens
tgcagaagcctatgagttgattaattctaacaactggatactgtggtttagggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcca

SEQ ID NO: 373623 - DNA, 2656 bp, Homo sapiens
  misc_feature (7)..(7): n is a, c, g, or t
  misc_feature (15)..(15): n is a, c, g, or t
gcatttnatgccccntttgactctagaccatcccacctttttagtgctccctgggggccaggagcgcttcagcctctaccaaaccagaagtctgatccatgagctgaagaataaagaaattcattttcaaaggaaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcca

SEQ ID NO: 373624 - DNA, 4529 bp, Homo sapiens
  misc_feature (7)..(7): n is a, c, g, or t
  misc_feature (15)..(15): n is a, c, g, or t
gcatttnatgccccntttgactctagaccatcccacctttttagtgctccctgggggccaggagcgcttcagcctctaccaaaccagaagtctgatccatgagctgaagaataaagaaattcattttcaaaggaaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccagacttctgttgtactgaattctg

SEQ ID NO: 373625 - DNA, 4388 bp, Homo sapiens
  misc_feature (7)..(7): n is a, c, g, or t
  misc_feature (15)..(15): n is a, c, g, or t
gcatttnatgccccntttgactctagaccatcccacctttttagtgctccctgggggccaggagcgcttcagcctctaccaaaccagaagtctgatccatgagctgaagaataaagaaattcattttcaaaggaaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccagacttctgttgtactgaattctg

SEQ ID NO: 373626 - DNA, 4190 bp, Homo sapiens
  misc_feature (7)..(7): n is a, c, g, or t
  misc_feature (15)..(15): n is a, c, g, or t
gcatttnatgccccntttgactctagaccatcccacctttttagtgctccctgggggccaggagcgcttcagcctctaccaaaccagaagtctgatccatgagctgaagaataaagaaattcattttcaaaggaaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggccaccgagttgattagagggtcactgctccatcgttgcttcaggcaaaagagtctccatcttcattccaaatgaggctcatgcagacccatctaagctgaggagatgggatctaaaggtacagcagaagacaaccctaacttcaccgcccctccattctgctgcgactcagctcacaaagcagattctcacagaagcaagtcctggggcaggagcaatactggcccgctaggcaagcagaagacttgcgtgccagtccaagctttgccatgagtagttttatgaccttgaataggtgaatttgcccccgtgggctttaatttacacagatatgaaaggtggagttgaactttgatgtgagaggtttacaaacttactgtgtctgtaggggtgttctggacattgtggtgggaggtaagggggtatcacaagggggccccatttaaatcacagcagccgtgcatgtcaggttgcacctgatagattctgcagttttaaaatatttttctttaaatttttaaactgtttgaagtgcatggtcactgtcagcactggacttggactgcctgtgttcagctcaatcacctactccccacgtgaccttcagcaagtttgcttagaccgtgtctagttccacaaccagaaaataaggaaatagcagttattataataaggattaaatgtgaatgtctgaggcactgagaactgtgtctggcacagatattatctttagatactaaataatgtgtttttatctttttaaaagattttcagcaacttaaaaaaaaatgtg

SEQ ID NO: 373627 - DNA, 3013 bp, Homo sapiens
  misc_feature (7)..(7): n is a, c, g, or t
  misc_feature (15)..(15): n is a, c, g, or t
gcatttnatgccccntttgactctagaccatcccacctttttagtgctccctgggggccaggagcgcttcagcctctaccaaaccagaagtctgatccatgagctgaagaataaagaaattcattttcaaaggaaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatgtaagtcttaacttcactgggagtacagcctatgtctgtgagtcatacttacatttgcaagagagagagattttggtgtaaactgcgtgtattcattccccaggcatattttgagttggttttcttatggtgacagtgtctctgttgagctgtccatacttcattagaaccccggcaaaaccgattagacttagagataggttctggccaaaaaccatctttctgtatgttggtgtggtgtaacagtcattattactgtcgagtcaggtgtctgtgcaaatagtgagcaagcaaggtgctggctttcctgactgctcctgagctctcaagcctttgtctttttgttgttgttgtggagacggagtctcattctgtcacccaggctggagtgcactggcacgatcttgacttactgcaatctctgcctcctgggttcaagtgattttcctgcctcagcctcccaagtagctgcgattacaggtgtgcaccaccatgcctggctaatttttgtatttttagtagagatgggggtttcaccatgttggccaggctggtcttgaactcctgacctcaagtgatccacctgcctcagcctc

SEQ ID NO: 373628 - DNA, 2084 bp, Homo sapiens
  misc_feature (1651)..(1651): n is a, c, g, or t
  misc_feature (1874)..(1874): n is a, c, g, or t
cactctgtaagttcaccgccggtcgggtccggccgccgcgctgtccagctcctgagaccttgctgtccgccggtctgccgtctgcgcgcctcacgctcctcagccctggaccggggacaagtaaccctcggtgacaagaccaaagtgcactgctgcccacacagttcctacctttctggcttcaattcttcagaagagtttgccgtcctttggggagaacgtgatttttgttatctcagcccactgacttcattgatctctaatcttttttaattccttgggccaactttgttcgtgcccccacactgtagccagaagcccgttggcgagctctggcacctgcaaaccaccccgtggaacgagtgtttcctctggctgagggttggagaggaggtgtggtctcagcaggcggcccgtagcctcacagccaggcctggtggtgaggtcaccatgtccaccaaggtgcccatctatctgaagcgtggcagtcgcaagggcaagaaggagaagcttcgggacctgctgtcctcggacatgatcagcccaccgctgggggacttccgccacaccattcatattggcagtggcggcggcagtgacatgtttggcgacatctccttcctgcagggcaagttccacctcctgccggggaccatggtggaggggcctgaagaagatggcaccttcgacctccccttccagttcacccgcaccgccaccgtgtgtgggcgggagctcccggacggcccatcccctctgctcaagaacgccatctccctcccggttatcggtggaccccaggctctcaccctgcccacagcccaggctccacccaagccccctcgcctgcacctggagacccctcagccttccccacaggagggagggagtgtggacatctggaggattccagagactggctcccccaacagtggactgaccccggagtcaggggccgaggagcccttcctgtccaatgccagctccctgctgtccctgcacgtggacctggggccttccatcctggatgatgtcctgcagatcatggatcaggacctggacagcatgcagatccccacataggacacgaggctgcctaggctggggtcccaggtggggcccagccaggaggtggggtgtggacccggccctggcggcggagtcagggtcccaagatcccacctgtatggtcgctggccagtgattctccttctgagccgtgtttcccctctccctccctctccacgtgggcagggcaggccccatcgctttcctctgataaccacatggacacatcctgaagtcagcccaggcgccctgagcatcttggggcacctggaccccatcacaatactccttcttccttcaggtccctgggtgaaggctttgctgaaaccgaccccccttttcacgtcccttctgcctctgccccgttggatgccctgactgggggcaggggaagagacagggcacagctggccacagggctcagccactgagcaggctgttccgggcctttggctttgcatcctggacggggagtgtcctgtcagggaccagatgtgtcctgcctcatccctagctccaatcccttccccacgtgaccggggattctggttgcaataaaacatgctgctgctggtaaaaaaanaaaacaaaaatgaaaccacgaatcaataaaaaaaaaaaaaaaagggggggggcgcccataaaaaattccccccgggggggcccccagttttacgctcttcccccgttttttttgttcacaagggggcccccttatgagggggggcgcatattataataaggacgagggacgacgcgcgccgctgctttaaccacccgcctcgtgacgtggacacacactggtnccgtgggggaacatccttgagggagggacccctactttgcggtgggcggcgccacctatgggagcaacactccccacaggagatttagaagccccgacagcaaaataacacttgctgaccgcgttcttactgcgtgtaaccacacgcgcaaatagtgctgagcgtgggaaagaatgggtccacggaatgacttttcgaacattttaccgg

SEQ ID NO: 373629 - DNA, 347 bp, Homo sapiens
gtgagttcgggctgggattttcgcagcttcgcgggggtcccccgagaggcccatctctgtggcgccccgccccagctcgcgccctggctctgcctctcacctcactcagttcctttcgagggctcctagggctccatggggcttcccacccgcatctgggttcccgcagcctcgcccgtgcccgccacggtccgtgggggcgcaacgcatcccgaccccgaattccccgttctgccctccattttgtgtccgggcccccgcccccctcccgagacccaggggtgccccgccgcccagcatccccaccggggctgggggccgtatttttagccgatagtgagttgttc

SEQ ID NO: 373630 - DNA, 1976 bp, Homo sapiens
cactctgtaagttcaccgccggtcgggtccggccgccgcgctgtccagctcctgagaccttgctgtccgccggtctgccgtctgcgcgcctcacgctcctcagccctggaccggggacaagtaaccctcggtgacaagaccaaagtgcactgctgcccacacagttcctacctttctggcttcaattcttcagaagagtttgccgtcctttggggagaacgtgatttttgttatctcagcccactgacttcattgatctctaatcttttttaattccttgggccaactttgttcgtgcccccacactgtagccagaagcccgttggcgagctctggcacctgcaaaccaccccgtggaacgagtgtttcctctggctgagggttggagaggaggtgtggtctcagcaggcggcccgtagcctcacagccaggcctggtggtgaggtcaccatgtccaccaaggtgcccatctatctgaagcgtggcagtcgcaagggcaagaaggagaagcttcgggacctgctgtcctcggacatgatcagcccaccgctgggggacttccgccacaccattcatattggcagtggcggcggcagtgacatgtttggcgacatctccttcctgcagggcaagttccacctcctgccggggaccatggtggaggggcctgaagaagatggcaccttcgacctccccttccagttcacccgcaccgccaccgtgtgtgggcgggagctcccggacggcccatcccctctgctcaagaacgccatctccctcccggttatcggtggaccccaggctctcaccctgcccacagcccaggctccacccaagccccctcgcctgcacctggagacccctcagccttccccacaggagggagggagtgtggacatctggaggattccagagactggctcccccaacagtggactgaccccggagtcaggggccgaggagcccttcctgtccaatgccagctccctgctgtccctgcacgtggacctggggccttccatcctggatgatgtcctgcagatcatggatcaggacctggacagcatgcagatccccacataggacacgaggctgcctaggctggggtcccaggtggggcccagccaggaggtggggtgtggacccggccctggcggcggagtcagggtcccaagatcccacctgtatggtcgctggccagtgattctccttctgagccgtgtttcccctctccctccctctccacgtgggcagggcaggccccatcgctttcctctgataaccacatggacacatcctgaagtcagcccaggcgccctgagcatcttggggcacctggaccccatcacaatactccttcttccttcaggtccctgggtgaaggctttgctgaaaccgaccccccttttcacgtcccttctgcctctgccccgttggatgccctgactgggggcaggggaagagacagggcacagctggccacagggctcagccactgagcaggctgttccgggcctttggctttgcatcctggacggggagtgtcctgtcagggaccagatgtgtcctgcctcatccctagctccaatcccttccccacgtgaccggggattctggttgcaataaaacatgctgctgctggtggcggagctccctgtccctttgccccaggtttcctcccggaggcagacagtctcccagagctgagggcttgcctctggagaccccagccccagagggctttgtggaggacaggccttgccctcaagaatgtcgtacctgacgctgagcctgtcatgagaatgcaacaggagcaaaccaagtgttgctgtgacattgattcagatgtttggcaagaggtggctgagcactggggtgggcttggcactgtgccaagcctggggccaatccctgcccagtcagctggggtctggtgggggacacccaagaataaaagaataaccacaaagtgtgca

SEQ ID NO: 373631 - DNA, 3399 bp, Homo sapiens
  misc_feature (2)..(2): n is a, c, g, or t
  misc_feature (4)..(6): n is a, c, g, or t
gnannngatgcggctgtggtggcggcggcggcggccgagcgcgggtggcggctgtggcggcggaggggggcgcgggccggcgatggcgcggcggccctgagggcgcggggcgggcggcggccggagggcgggcggcgcgggaggaagcggcggcggtggctccatggcccgggcgcgctgagggacccggcgctcgcctcagcccggcggcggcggcggccgaacaatgaagctcctgaagccgacctgggtcaaccacaatggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaagggatgttcacagacaggtggttgtggtgaaagaagagtctctacactccatcctggcaggaagtgatatgacggtatcacagatcttgctgacgcagcatggaatcccagtaatgaacctgtccgatgggaaggcgtactgctttaatccgtcactttccacatggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtttgaataccgacttcgagaaatatgcaaggacttactgggtccggttcactactccactggaagccagtgggagtcaacagtagtgggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcgccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaatacca

SEQ ID NO: 373632 - DNA, 569 bp, Homo sapiens
tacagtcaatggcatctgacaattagtagcattgttttctttcttagtagtacatatagaacctgtaaatcctagattcaattaaatatagtatattaagtggctttaattttctttttacttttctgtaactttgcagattttctatcatgaaaacatactgcctttggacctagaaaaaagttatttgaatgtataaagtactggatgtggcacctgactttcaaggctgacttttgttcttacttgatgacagggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacaggttagtgggtgccaaggcttgttcctgtccctggggaaagttcaggtttgcacatagttttgaggacagagaattttattctgtttgcactttgtggccccttcaatcaaaaaag

SEQ ID NO: 373633 - DNA, 463 bp, Homo sapiens
tcaaagacatccatagaggaagccccttaggggcaggaggtgaggacttcatctcaacatcggctggtggttggtaggggagctttttcttttctttccttttttttgttttgtgtatgtagtattgagtttttggtaacatgttaggagttaatgttgcaaagagtagtttacatcttcactttctgaagacacttgaatttgggtccggttcactactccactggaagccagtgggagtcaacagtagtggtaggtgcttctttcattgttgctgcaagaattctttcttgaaacatgaaggtggagattttttaaataagccaaagtgctttgaaattgtgtcccgttagacttctccagcacccagcctcaggtcccagcatcagtgagagggtgacatgccgacggccctccacaacctggcaggagctgggccctggacatcaggagccacggagtg

SEQ ID NO: 373634 - DNA, 2635 bp, Homo sapiens
tacagtcaatggcatctgacaattagtagcattgttttctttcttagtagtacatatagaacctgtaaatcctagattcaattaaatatagtatattaagtggctttaattttctttttacttttctgtaactttgcagattttctatcatgaaaacatactgcctttggacctagaaaaaagttatttgaatgtataaagtactggatgtggcacctgactttcaaggctgacttttgttcttacttgatgacagggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccagtctccagctgccctaaccgcagagaaggaggccatgtgtctgtctgcaccagcacttgcactgaagctgccaattccaagcccccagagagcattcaccctccaggtcagctccgatccttccatgtacattgaggtggagaatgaagtgacagtggtggggggcgtgaagctgagccgcctgaagtgcaaccgggaagggaaggagtgggagacggtactcaccagccggatcctcactgctgcgggcagctgtgacgtggtgtgtgtcgcctgtgaaaaaaggatgctgtcagtgttctccacctgtggtcgccgtctcctctctcccatcctcctgccatccccgatctctactttgcattgcacaggctcctacgtcatggcgctcaccgctgcagccacactctctgtctgggatgttcacagacaggtggttgtggtgaaagaagagtctctacactccatcctggcaggaagtgatatgacggtatcacagatcttgctgacgcagcatggaatcccagtaatgaacctgtccgatgggaaggcgtactgctttaatccgtcactttccacatggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtttgaataccgacttcgagaaatatgcaaggacttactgggtccggttcactactccactggaagccagtgggagtcaacagtagtgggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcgccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaatacca

SEQ ID NO: 373635 - DNA, 1458 bp, Homo sapiens
gtagggatatcgtcgaaccacggcgctcgggcgctcaccgtgcagcacactctctgtctgggatgttcacagacaggtggttgtggtgaaagaagagtctctacactccatcctggcaggaagtgatatgacggtatcacagatcttgctgacgcagcatggaatcccagtaatgaacctgtccgatgggaaggcgtactgctttaatccgtcactttccacatggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtttgaataccgacttcgagaaatatgcaaggacttactgggtccggttcactactccactggaagccagtgggagtcaacagtagtgggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcgccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaatacca

SEQ ID NO: 373636 - DNA, 1954 bp, Homo sapiens
  misc_feature (2)..(2): n is a, c, g, or t
  misc_feature (4)..(6): n is a, c, g, or t
gnannngatgcggctgtggtggcggcggcggcggccgagcgcgggtggcggctgtggcggcggaggggggcgcgggccggcgatggcgcggcggccctgagggcgcggggcgggcggcggccggagggcgggcggcgcgggaggaagcggcggcggtggctccatggcccgggcgcgctgagggacccggcgctcgcctcagcccggcggcggcggcggccgaacaatgaagctcctgaagccgacctgggtcaaccacaatggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacaggttagtgggtgccaaggcttgttcctgtccctggggaaagttcaggtttgcacatagttttgaggacagagaattttattctgtttgcactttgtggccccttcaatcaaaaaag

SEQ ID NO: 373637 - DNA, 188 bp, Homo sapiens
aaagaagagtctctacactccatcctggcaggtaatgcaggcaacaggctgtccctactcttttgggggcccaagttcatgtctgatgctgcagaagggccccgctcagagagccaggctctggcctcagcccagggctctcagtgaggcaggaggtgtggttacgctgcaggagacacacacttttt

SEQ ID NO: 373638 - DNA, 374 bp, Homo sapiens
aatggcttgccctccctatttgccaaggcagtgttgatgcatttgctgctgggactgtgggagcctagagtacagatttctcctttgatatgtttgaaaacacttgctgatcagagcacacccagaactcattcccatgctgtcctcaggaagtgatatgacggtatcacagatcttgctgacgcagcatggaatcccagtaatgaacctgtccgatgggaaggcgtactgctttaatccgtcactttccacatggtaagcaagctgacccccagtcctattccctggaagagtgtctgtctgctctagacagcagagcaaagggtcgtggcctacagggctgcctagccctgcttttcctgagagtcaggccc

SEQ ID NO: 373639 - DNA, 407 bp, Homo sapiens
cagccattctcagtgatggaatgctttctcccactgttggactttcagttgtctgatgtttggagaatcttctagcagtttagactttaactgaatctgttgagtttgatacacttcaatgaataaaagccaatttagatactgtatttttttttctttgtttccaggcaagccgattttttcagttgatattcaccctgacgggaccaagttcgcaactggaggacaaggtatgtttatggaataaagaaagggaaagcttaacagccctgccaccttgctcttctcctgctgtccatttagctgtagagggaatacttgctatttttcaggatggatgcaacgctgtttaaaatgtacagttataatgtgttatctgaatgaataaaatcaaaatccttttatgg

SEQ ID NO: 373640 - DNA, 4020 bp, Homo sapiens
  misc_feature (2)..(2): n is a, c, g, or t
  misc_feature (4)..(6): n is a, c, g, or t
gnannngatgcggctgtggtggcggcggcggcggccgagcgcgggtggcggctgtggcggcggaggggggcgcgggccggcgatggcgcggcggccctgagggcgcggggcgggcggcggccggagggcgggcggcgcgggaggaagcggcggcggtggctccatggcccgggcgcgctgagggacccggcgctcgcctcagcccggcggcggcggcggccgaacaatgaagctcctgaagccgacctgggtcaaccacaatggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccagtctccagctgccctaaccgcagagaaggaggccatgtgtctgtctgcaccagcacttgcactgaagctgccaattccaagcccccagagagcattcaccctccaggtcagctccgatccttccatgtacattgaggtggagaatgaagtgacagtggtggggggcgtgaagctgagccgcctgaagtgcaaccgggaagggaaggagtgggagacggtactcaccagccggatcctcactgctgcgggcagctgtgacgtggtgtgtgtcgcctgtgaaaaaaggatgctgtcagtgttctccacctgtggtcgccgtctcctctctcccatcctcctgccatccccgatctctactttgcattgcacaggctcctacgtcatggcgctcaccgctgcagccacactctctgtctgggatgttcacagacaggtggttgtggtgaaagaagagtctctacactccatcctggcaggaagtgatatgacggtatcacagatcttgctgacgcagcatggaatcccagtaatgaacctgtccgatgggaaggcgtactgctttaatccgtcactttccacatggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtttgaataccgacttcgagaaatatgcaaggacttactgggtccggttcactactccactggaagccagtgggagtcaacagtagtgggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcgccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaatacca

SEQ ID NO: 373641 - DNA, 4792 bp, Homo sapiens
  misc_feature (2)..(2): n is a, c, g, or t
  misc_feature (4)..(6): n is a, c, g, or t
gnannngatgcggctgtggtggcggcggcggcggccgagcgcgggtggcggctgtggcggcggaggggggcgcgggccggcgatggcgcggcggccctgagggcgcggggcgggcggcggccggagggcgggcggcgcgggaggaagcggcggcggtggctccatggcccgggcgcgctgagggacccggcgctcgcctcagcccggcggcggcggcggccgaacaatgaagctcctgaagccgacctgggtcaaccacaatggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccagtctccagctgccctaaccgcagagaaggaggccatgtgtctgtctgcaccagcacttgcactgaagctgccaattccaagcccccagagagcattcaccctccaggtcagctccgatccttccatgtacattgaggtggagaatgaagtgacagtggtggggggcgtgaagctgagccgcctgaagtgcaaccgggaagggaaggagtgggagacggtactcaccagccggatcctcactgctgcgggcagctgtgacgtggtgtgtgtcgcctgtgaaaaaaggatgctgtcagtgttctccacctgtggtcgccgtctcctctctcccatcctcctgccatccccgatctctactttgcattgcacaggctcctacgtcatggcgctcaccgctgcagccacactctctgtctgggatgttcacagacaggtggttgtggtgaaagaagagtctctacactccatcctggcaggaagtgatatgacggtatcacagatcttgctgacgcagcatggaatcccagtaatgaacctgtccgatgggaaggcgtactgctttaatccgtcactttccacatggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtttgaataccgacttcgagaaatatgcaaggacttactgggtccggttcactactccactggaagccagtgggagtcaacagtagtgggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcgccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaataccaaaaaaaactgatttctcttgccttttccttctaactttcatcctccccacacagtgcatctctctcctgaagtagatggtgacagaacatgagagccagaagggatcctttgtgtcatctcattcccccctgtcatggttaatactgcgtgtcaacttgattggattgaaggatgcaatattgatcctggatgtgtctgtgagggtgttgccaaaggagattaacatttgagtcaggctggggaaggcagacccactcttaatcaggtgggcaccatctaatcagctgccaacgaatataaagcaggcagaaaaatgtgaagagatgagacttgcttagcctcccagcctacatctttctcccgtgctggatgcttcctgccctcaaacatcggactcccaagttcttcaattttgggactcgaactggctctccttgctcctcagcttgcagatggcctattgtgggaccttgtgattgtgtaagttaatacttaataaactttcatatatatctattagttctgtccctgtagagaaccctaatataccccccatgcagaaattcatttcacagtgtagagtggtcacttctgtggtcatgaagcaccataggtcaccttgcacacgtcatctcacaagtgaggagtcatggttcatggtggttcatggttctggtcttgctgtgccccaggtccagatcatactgtgcaccaagggctgcagctgtttggacaatttcatgaaaggaaatcagtatttacagtcttggg

SEQ ID NO: 373642 - DNA, 3511 bp, Homo sapiens
tttgtttcttcaactcaccaatcattcttctgtatacctagcactgcaccaggcgctgaggttagagaaataactaagactgcgcccttcacccctgatggcaggataggcaagatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccagtctccagctgccctaaccgcagagaaggaggccatgtgtctgtctgcaccagcacttgcactgaagctgccaattccaagcccccagagagcattcaccctccaggtcagctccgatccttccatgtacattgaggtggagaatgaagtgacagtggtggggggcgtgaagctgagccgcctgaagtgcaaccgggaagggaaggagtgggagacggtactcaccagccggatcctcactgctgcgggcagctgtgacgtggtgtgtgtcgcctgtgaaaaaaggatgctgtcagtgttctccacctgtggtcgccgtctcctctctcccatcctcctgccatccccgatctctactttgcattgcacaggctcctacgtcatggcgctcaccgctgcagccacactctctgtctgggatgttcacagacaggtggttgtggtgaaagaagagtctctacactccatcctggcaggaagtgatatgacggtatcacagatcttgctgacgcagcatggaatcccagtaatgaacctgtccgatgggaaggcgtactgctttaatccgtcactttccacatggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtttgaataccgacttcgagaaatatgcaaggacttactgggtccggttcactactccactggaagccagtgggagtcaacagtagtgggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcgccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaatacca

SEQ ID NO: 373643 - DNA, 4089 bp, Homo sapiens
  misc_feature (2)..(2): n is a, c, g, or t
  misc_feature (4)..(6): n is a, c, g, or t
gnannngatgcggctgtggtggcggcggcggcggccgagcgcgggtggcggctgtggcggcggaggggggcgcgggccggcgatggcgcggcggccctgagggcgcggggcgggcggcggccggagggcgggcggcgcgggaggaagcggcggcggtggctccatggcccgggcgcgctgagggacccggcgctcgcctcagcccggcggcggcggcggccgaacaatgaagctcctgaagccgacctgggtcaaccacaatggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgaacttcccacgttctgctgtttgtcctgctgaacagaatcagtaccttcatcagcggatcactaagtccatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccagtctccagctgccctaaccgcagagaaggaggccatgtgtctgtctgcaccagcacttgcactgaagctgccaattccaagcccccagagagcattcaccctccaggtcagctccgatccttccatgtacattgaggtggagaatgaagtgacagtggtggggggcgtgaagctgagccgcctgaagtgcaaccgggaagggaaggagtgggagacggtactcaccagccggatcctcactgctgcgggcagctgtgacgtggtgtgtgtcgcctgtgaaaaaaggatgctgtcagtgttctccacctgtggtcgccgtctcctctctcccatcctcctgccatccccgatctctactttgcattgcacaggctcctacgtcatggcgctcaccgctgcagccacactctctgtctgggatgttcacagacaggtggttgtggtgaaagaagagtctctacactccatcctggcaggaagtgatatgacggtatcacagatcttgctgacgcagcatggaatcccagtaatgaacctgtccgatgggaaggcgtactgctttaatccgtcactttccacatggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtttgaataccgacttcgagaaatatgcaaggacttactgggtccggttcactactccactggaagccagtgggagtcaacagtagtgggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcgccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaatacca

SEQ ID NO: 373644 - DNA, 3158 bp, Homo sapiens
tgcagatgcttctttcagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccagtctccagctgccctaaccgcagagaaggaggccatgtgtctgtctgcaccagcacttgcactgaagctgccaattccaagcccccagagagcattcaccctccaggtcagctccgatccttccatgtacattgaggtggagaatgaagtgacagtggtggggggcgtgaagctgagccgcctgaagtgcaaccgggaagggaaggagtgggagacggtactcaccagccggatcctcactgctgcgggcagctgtgacgtggtgtgtgtcgcctgtgaaaaaaggatgctgtcagtgttctccacctgtggtcgccgtctcctctctcccatcctcctgccatccccgatctctactttgcattgcacaggctcctacgtcatggcgctcaccgctgcagccacactctctgtctgggatgttcacagacaggtggttgtggtgaaagaagagtctctacactccatcctggcaggaagtgatatgacggtatcacagatcttgctgacgcagcatggaatcccagtaatgaacctgtccgatgggaaggcgtactgctttaatccgtcactttccacatggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtttgaataccgacttcgagaaatatgcaaggacttactgggtccggttcactactccactggaagccagtgggagtcaacagtagtgggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcgccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaatacca

SEQ ID NO: 373645 - DNA, 3168 bp, Homo sapiens
  misc_feature (2)..(2): n is a, c, g, or t
  misc_feature (4)..(6): n is a, c, g, or t
gnannngatgcggctgtggtggcggcggcggcggccgagcgcgggtggcggctgtggcggcggaggggggcgcgggccggcgatggcgcggcggccctgagggcgcggggcgggcggcggccggagggcgggcggcgcgggaggaagcggcggcggtggctccatggcccgggcgcgctgagggacccggcgctcgcctcagcccggcggcggcggcggccgaacaatgaagctcctgaagccgacctgggtcaaccacaatggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccagtctccagctgccctaaccgcagagaaggaggccatgtgtctgtctgcaccagcacttgcactgaagctgccaattccaagcccccagagagcattcaccctccagggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcgccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaatacca

SEQ ID NO: 373646 - DNA, 2318 bp, Homo sapiens
  misc_feature (2)..(2): n is a, c, g, or t
  misc_feature (4)..(6): n is a, c, g, or t
  misc_feature (2257)..(2257): n is a, c, g, or t
gnannngatgcggctgtggtggcggcggcggcggccgagcgcgggtggcggctgtggcggcggaggggggcgcgggccggcgatggcgcggcggccctgagggcgcggggcgggcggcggccggagggcgggcggcgcgggaggaagcggcggcggtggctccatggcccgggcgcgctgagggacccggcgctcgcctcagcccggcggcggcggcggccgaacaatgaagctcctgaagccgacctgggtcaaccacaatggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccagtctccagctgccctaaccgcagagaaggaggccatgtgcccgccaggagcncgagagggggatgctctcttctcatagcagtcacacagctgctgcactgactcagtacaga

SEQ ID NO: 373647 - DNA, 1871 bp, Homo sapiens
  misc_feature (2)..(2): n is a, c, g, or t
  misc_feature (4)..(6): n is a, c, g, or t
gnannngatgcggctgtggtggcggcggcggcggccgagcgcgggtggcggctgtggcggcggaggggggcgcgggccggcgatggcgcggcggccctgagggcgcggggcgggcggcggccggagggcgggcggcgcgggaggaagcggcggcggtggctccatggcccgggcgcgctgagggacccggcgctcgcctcagcccggcggcggcggcggccgaacaatgaagctcctgaagccgacctgggtcaaccacaatggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgcgtccgtcgaagttgggttaccgg

SEQ ID NO: 373648 - DNA, 1947 bp, Homo sapiens
  misc_feature (2)..(2): n is a, c, g, or t
  misc_feature (4)..(6): n is a, c, g, or t
gnannngatgcggctgtggtggcggcggcggcggccgagcgcgggtggcggctgtggcggcggaggggggcgcgggccggcgatggcgcggcggccctgagggcgcggggcgggcggcggccggagggcgggcggcgcgggaggaagcggcggcggtggctccatggcccgggcgcgctgagggacccggcgctcgcctcagcccggcggcggcggcggccgaacaatgaagctcctgaagccgacctgggtcaaccacaatggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactgggtactggttcattcccctttcatggtcttatctggcgagatcttcctgtcttctttcagcggttaacactttcacagtgaggatcttcacgggtccttcacaacctgactggtagaacatggaagcaaggaagtgaagctcagcttcccgcagtctcaaagcccatactcctcctggagcccttgtgcacacctgaatcatgtgaggggtgggagtgctaaggcggccagcacatctgctgcacttcactgttgccagggcaccagaggacgcacaaggaaagcagtcagtcaggctgattttttt

SEQ ID NO: 373649 - DNA, 4279 bp, Homo sapiens
accggagggggaggggcggagagccaccgcggagcgcgcgcggggttggttgccgcgagcgtgggggagcgtggaccgcggcgctgctcagcggtggggctgccttcccccggccctcctccctggtccctggcgagggcactggcggcggcggggccggggtccgcaaggccggagaaggccgccgggcccgggcatggtggtctggggcaacgcggaagaagctccaccatgaggcgaggtggatggaggaagcgagctgaaaatgatggctgggaaacatggggtgggtatatggctgccaaggtccagaaattggaggaacagtttcgatcagatgctgctatgcagaaggatgggacttcatctacaatttttagtggagttgccatctatgttaatggatacacagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagaggggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtat

SEQ ID NO: 373650 - DNA, 2057 bp, Homo sapiens
ttattgccttgccttatggtttatgtttatgaggtcatcattatgttctggtcactagcacagaataaggtccatttatttatttagtttttaaaatttttttttttcaaaaaaggggggagaaaatgtaacctttgtgattggtttaccttttctttaattctagggtgggtatatggctgccaaggtccagaaattggaggaacagtttcgatcagatgctgctatgcagaaggatgggacttcatctacaatttttagtggagttgccatctatgttaatggatacacagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggtagatacttattaaaattgtcttcttaagaaacagtcatgcttgatcattttgctcttatgctattattggtatttctggtcaatatgaagttctcataaaagtctctaagtatgtcaaatcatgtaagttacagtaagcataacatagaaagctaatttattaaaatatttttaaaacaattagatataattgtggctgactgaaaattttcagagaatttaaacagtaagatggttgggattctgagcattcattcctcacgtagaccttatcagttggtgaagttttgaactgtgttaatataacatctatccagtgcttaaactcctgtaagaatgaaattggtttgataagagtaattgttaatttctagaagcttgcatcataatgattttttaattttgacatagagctgttgtaattaacagtggtaaactttcagtgagattatttcacatcttaagtacattggttcattgtattttgttttttaatacttttcttgtcatcaaaaacaaatgcacacacagtagcatactgtttttctgggccagtcattataaattagtatctggtttgaaattttagttccttttacagattataggatttttttatggggagagacctcagagattaatactctataatttatagctgtggaaactgaggtatagagagaagctcatggttctgtcctagaaagtgatagagactctatgtggggtg

SEQ ID NO: 373651 - DNA, 759 bp, Homo sapiens
gcagtgtacctgctgttcatcactcccgccaatattttttgagaagtatttcatttaaaaaagataaaaatagtgaagtttccaagtagactgtcctctcttaatttttttttatcctaatttaaaaccttagttgacgagaacatcagtggaatacagtattccacttgtttggattttctgattttaaagatcttttggtatattttgggagaattggatactctgaagtttgagatgaatgaccactcactagctactttagaaattgtttttgtaataagtcatatagaatgctgtttgaatactttcatttacctttattctagaaacaggatccaggagatagtgaaaaggatttgctgaggattttgcttagctgaattcatattttcactttagttttcctagaagcatactctttattctgggttctaggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaaggttggtggtcatcagtgtggttcttttttaggtgctgcttatgtccttggaaagacggcagttggttttaaaattgacacagctttatgtgattttaaaaatttatattcttcattatgatgaatcagtaataaagtttttttatttgtaatgga

SEQ ID NO: 373652 - DNA, 722 bp, Homo sapiens
ttttaatagatgctgagcgtgatagtgagtaaccaacatgtttaatattcaaagttaaaatacttgagaacaattattaggtatataggaaagtggaatggtagtttctccacgtttgtctttccatagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggtaagctcacctcagaaatgatattggtaattatatttcagtacaggttgttgtaagtaatagaaaatgaagaaaaccaaggaggagtttgaataaagacctgtaaacccgttaatctggtattctgtagaagcaggcatcagcccaaggcattcagcttaggttaatgcacttggtttcagcgaggcccacacacaggaggttggtttgacggcattgctgaccttggcagcctttgcttggcatctttgggctgttaactttactgcatggacagaaagaaagggcaaggctgcagaccaaagggactgctatagtttcgggacttggtgaaacttttttcctgaggaaaatttcaatgtagttcttaaaaacaatgatacaggccaggtgtggtggctcatacctgtaatcccagca

SEQ ID NO: 373653 - DNA, 284 bp, Homo sapiens
tatggcattcacttttataatcttctttgtaactgtttacaacttttctataactcttttaaacagttccatactactttagtactagtgaatacatatggaatgaagcttttgttttttaattctatcacttacaggactgtaactcttgaccaggcaacagataatgcaaaaataattggaaaggcgatgctaaacatgtttcatacaatgaaactaaatatatcagatatgagaggggtaagtatatagtaacattgtaaattctgactttgtgtaatgta

SEQ ID NO: 373654 - DNA, 4934 bp, Homo sapiens
ttattgccttgccttatggtttatgtttatgaggtcatcattatgttctggtcactagcacagaataaggtccatttatttatttagtttttaaaatttttttttttcaaaaaaggggggagaaaatgtaacctttgtgattggtttaccttttctttaattctagggtgggtatatggctgccaaggtccagaaattggaggaacagtttcgatcagatgctgctatgcagaaggatgggacttcatctacaatttttagtggagttgccatctatgttaatggatacacagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagaggggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcaggttggcttggcctgtgttaagatggcccaaggctgagatgtagtcgtctcatgatttgagaacataaacagactaaactatgcagatttaacccatttctctaactctgataagcttaaagcagctacccccaaatcttttaaattctgggacttgctttgaaaagtaacaaagcccattcctttgatagctgttagtgacatagttgtagaaatgcagttttcctttatccatgcagatctctgactttctccttcaaaaagactggtcctcatttgaagtttttcccccttcctagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctaaa

SEQ ID NO: 373655 - DNA, 5022 bp, Homo sapiens
ttattgccttgccttatggtttatgtttatgaggtcatcattatgttctggtcactagcacagaataaggtccatttatttatttagtttttaaaatttttttttttcaaaaaaggggggagaaaatgtaacctttgtgattggtttaccttttctttaattctagggtgggtatatggctgccaaggtccagaaattggaggaacagtttcgatcagatgctgctatgcagaaggatgggacttcatctacaatttttagtggagttgccatctatgttaatggatacacagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagaggggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggtaattccttaactttgacctttatgagatcttaatatacctggataatgtgtgaatatagcaattttatcctttgttttcttaacaggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcaggttggcttggcctgtgttaagatggcccaaggctgagatgtagtcgtctcatgatttgagaacataaacagactaaactatgcagatttaacccatttctctaactctgataagcttaaagcagctacccccaaatcttttaaattctgggacttgctttgaaaagtaacaaagcccattcctttgatagctgttagtgacatagttgtagaaatgcagttttcctttatccatgcagatctctgactttctccttcaaaaagactggtcctcatttgaagtttttcccccttcctagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctaaa

SEQ ID NO: 373656 - DNA, 4535 bp, Homo sapiens
ttattgccttgccttatggtttatgtttatgaggtcatcattatgttctggtcactagcacagaataaggtccatttatttatttagtttttaaaatttttttttttcaaaaaaggggggagaaaatgtaacctttgtgattggtttaccttttctttaattctagggtgggtatatggctgccaaggtccagaaattggaggaacagtttcgatcagatgctgctatgcagaaggatgggacttcatctacaatttttagtggagttgccatctatgttaatggatacacagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagaggggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctaaa

SEQ ID NO: 373657 - DNA, 3029 bp, Homo sapiens
gcggccgctcccacatcagaatgttaacagcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagaggggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctaaa

SEQ ID NO: 373658 - DNA, 2514 bp, Homo sapiens
gcagtgtacctgctgttcatcactcccgccaatattttttgagaagtatttcatttaaaaaagataaaaatagtgaagtttccaagtagactgtcctctcttaatttttttttatcctaatttaaaaccttagttgacgagaacatcagtggaatacagtattccacttgtttggattttctgattttaaagatcttttggtatattttgggagaattggatactctgaagtttgagatgaatgaccactcactagctactttagaaattgtttttgtaataagtcatatagaatgctgtttgaatactttcatttacctttattctagaaacaggatccaggagatagtgaaaaggatttgctgaggattttgcttagctgaattcatattttcactttagttttcctagaagcatactctttattctgggttctaggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctaaa

SEQ ID NO: 373659 - DNA, 2065 bp, Homo sapiens
cctccctggggtgggatctaatttgagcttcaccaaggctattcatatctgttggccccaattgcaggacattctgtgagtatatttggacttacctggtcatgtgatagtggctggtagtatatatacacttctttccagactacacatagtacttcaggcttcaatgacaaaaggccaagacgttccaaaaatgtgctgatttggaggtggctttcctagcttgatggtctgtaccttacattgattatccacagtattcaaattgaaatttaaagtggcgtgttaactcccaaacacctcatctccgagcatgctttaacttcctactcatatgtttggcattttatagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctaaa

SEQ ID NO: 373660 - DNA, 1913 bp, Homo sapiens
gacaaagagtaatggagtcactgttgtctaattattgcagtatataatgggcaaagtctaagctgttgcattaagagctcttcatattgggataatatctgaagtatacagtatgagtaaatatcatcatatttctagttggatttgtgtctgtactttcaggatttaaacacaccactttttactttttaaaaaagttggaataggacattaccacaaatgtcttaaatacttgttcagctagttgtcctttgagatgaatacattaaaggatgttggttcaaaatgcatcacaaacatcaaacccacatttagtactacccatcatagatgagcaacatgccaaaggtcaaattagtaagtggcaaagcaaagagagaattggagagcctgtactttgggccattgccattcactgcctctcacttggggcaggaggggaggtgtaggctagggagcctgttgtatttgggaggagaaaagagaacccaatactgtcatccagactatccatactatcattttgttgaggatcttatatccatctgctcttagtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctaaa

SEQ ID NO: 373661 - DNA, 1756 bp, Homo sapiens
tgcttcccattttctactagtgcattttgcccaggttctgctgttgtagtgggtttctttaagttagtactcttaattccttattcttgctcttaattccttattcttgctctaaccattttgaagatttaatcagctttgatattggggaactgttaagaattcgtacagatcagaaaagtgagatttgaaaacaaagtctgttttgtgaaaaagagaaaccagctaccatctacaattagctcaggtttgactttgacctcgtcttttccactaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctaaa

SEQ ID NO: 373662 - DNA, 3769 bp, Homo sapiens
ttattgccttgccttatggtttatgtttatgaggtcatcattatgttctggtcactagcacagaataaggtccatttatttatttagtttttaaaatttttttttttcaaaaaaggggggagaaaatgtaacctttgtgattggtttaccttttctttaattctagggtgggtatatggctgccaaggtccagaaattggaggaacagtttcgatcagatgctgctatgcagaaggatgggacttcatctacaatttttagtggagttgccatctatgttaatggatacacagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagaggggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccaggtacatttttgtagtcctaaatataagtacattttatactcctaaatataaatacaaaaatacaagtttacaaatgaaaatggcatttttatttcttcatctgtttaaccaagaaagggagaacgggccacttgtttgggtagatcatgatgttggattctaaataagcaatatttgggttgagtgaaagtgcttttgcaaagatttgccactcttgcaagttgtaaagcatagctgaaaggcagtcctcctgtggactgccattgtctgtgacagtggtcatcatgcagacttactgtattcagcaaggcagctttggtgattagtggtgaagtagaggccttatgtcgaagggtttttgcagtatttgcaaacaggtctctggagatttggatggtttaattcagcgtgtgtgggctgtacatgtgatatactgctggtccttgaaagtaaggtagcaccttaagctatattgggcaagtttatttgtgcctctgctccccctgcatggaaggaggcggaaggagatgttaaatactggctgcaaaactaggggaaagggcaatgctgatatgcttgtatggcgacagatacccacaattagttactcctggcaagataagattggtccacccagttgatgggatagcatgtttccaaagggccagatgtggattttcaggtaggccctggccaaaggaacagtggattctgtcctgtaagttagagaaaattcagcttctagaaaacctttcttccaagtgtgctgctctcagagtagaattatttgtatttatgggcagtctctcatctgaaaggtgaactttggacccaggactgttacct

SEQ ID NO: 373663 - DNA, 598 bp, Homo sapiens
gttttgtgcataaatggtgggtattttgtgttaataaacttgttattagtagcttattctgcatacttaactatattccctttcctaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcaggtactgatcattgaacagattttgccatctgttgctctttatatttttacatagtcctacctctacaactaaaccattagaccctcaatgcttgaaattaagtcttaaaactgttgtatccccagagccttaagaaggccttttaaggcactgtgtggtaaggtgtagccccagataagactgagactgaggaaacttagctcttggggaaatatactaaaagattatgctttggaggccagttattagagaacttgagattataattattctaattaacagtgaaaaa

SEQ ID NO: 373664 - DNA, 375 bp, Homo sapiens
tgccaaagtcaatttttatatataaaaaggaataattagtcttaaggacctttcctaattcctaatgacatttcttctctccccacctttaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgt

SEQ ID NO: 373665 - DNA, 4755 bp, Homo sapiens
accggagggggaggggcggagagccaccgcggagcgcgcgcggggttggttgccgcgagcgtgggggagcgtggaccgcggcgctgctcagcggtggggctgccttcccccggccctcctccctggtccctggcgagggcactggcggcggcggggccggggtccgcaaggccggagaaggccgccgggcccgggcatggtggtctggggcaacgcggaagaagctccaccatgaggcgaggtggatggaggaagcgagctgaaaatgatggctgggaaacatggggtgggtatatggctgccaaggtccagaaattggaggaacagtttcgatcagatgctgctatgcagaaggatgggacttcatctacaatttttagtggagttgccatctatgttaatggatacacagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagaggggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctaaa

SEQ ID NO: 373666 - DNA, 4636 bp, Homo sapiens
ttattgccttgccttatggtttatgtttatgaggtcatcattatgttctggtcactagcacagaataaggtccatttatttatttagtttttaaaatttttttttttcaaaaaaggggggagaaaatgtaacctttgtgattggtttaccttttctttaattctagggtgggtatatggctgccaaggtccagaaattggaggaacagtttcgatcagatgctgctatgcagaaggatgggacttcatctacaatttttagtggagttgccatctatgttaatggatacacagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagaggggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctaaa

SEQ ID NO: 373667 - DNA, 4912 bp, Homo sapiens
accggagggggaggggcggagagccaccgcggagcgcgcgcggggttggttgccgcgagcgtgggggagcgtggaccgcggcgctgctcagcggtggggctgccttcccccggccctcctccctggtccctggcgagggcactggcggcggcggggccggggtccgcaaggccggagaaggccgccgggcccgggcatggtggtctggggcaacgcggaagaagctccaccatgaggcgaggtggatggaggaagcgagctgaaaatgatggctgggaaacatggggtgggtatatggctgccaaggtccagaaattggaggaacagtttcgatcagatgctgctatgcagaaggatgggacttcatctacaatttttagtggagttgccatctatgttaatggatacacagattggttttcatgcttcacttcacactgaagaatatgtaagagctttcagaagtgaacttcaaagagccctcttaacttcatccagtagaagggcaatgtattttccagttccaaatttctggagtaattagttttcaaagagcagctagtagacggatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagaggggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctaaa

SEQ ID NO: 373668 - DNA, 4577 bp, Homo sapiens
ttattgccttgccttatggtttatgtttatgaggtcatcattatgttctggtcactagcacagaataaggtccatttatttatttagtttttaaaatttttttttttcaaaaaaggggggagaaaatgtaacctttgtgattggtttaccttttctttaattctagggtgggtatatggctgccaaggtccagaaattggaggaacagtttcgatcagatgctgctatgcagaaggatgggacttcatctacaatttttagtggagttgccatctatgttaatggatacacagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagagggtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctaaa

SEQ ID NO: 373669 - DNA, 2877 bp, Homo sapiens
ttattgccttgccttatggtttatgtttatgaggtcatcattatgttctggtcactagcacagaataaggtccatttatttatttagtttttaaaatttttttttttcaaaaaaggggggagaaaatgtaacctttgtgattggtttaccttttctttaattctagggtgggtatatggctgccaaggtccagaaattggaggaacagtttcgatcagatgctgctatgcagaaggatgggacttcatctacaatttttagtggagttgccatctatgttaatggatacacagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggtaagctcacctcagaaatgatattggtaattatatttcagtacaggttgttgtaagtaatagaaaatgaagaaaaccaaggaggagtttgaataaagacctgtaaacccgttaatctggtattctgtagaagcaggcatcagcccaaggcattcagcttaggttaatgcacttggtttcagcgaggcccacacacaggaggttggtttgacggcattgctgaccttggcagcctttgcttggcatctttgggctgttaactttactgcatggacagaaagaaagggcaaggctgcagaccaaagggactgctatagtttcgggacttggtgaaacttttttcctgaggaaaatttcaatgtagttcttaaaaacaatgatacaggccaggtgtggtggctcatacctgtaatcccagca

SEQ ID NO: 373670 - DNA, 929 bp, Homo sapiens
agcgggctgcagggctgcgggcgcttggttcggcctggcccggccggcggctcctaacaccgggcgggcggctgcggcggcacttccgggttggccttctccatgttggtctcgggaacgtgaaggggcggggcctcgaggtcaggggtcagcacctccctggttgccgtggcgactggaggcgcgcgacgcgggcgcaatggcggggacccggggcttgatgctgcttgggcctggcccagtggcgggtcctagggacgtgggtacctgcagaggccggcagatggagattcagaaacataaggacaacaagaaacttccccaaggtatcattatagtctttagacttcagacacacaccacacctcaaatatatacacaactgaaaggaaaattaaggaagtttttcaaagaaccctattccgagtaagaagtgtgttgcatgaatttctaaggtcaaagatgttgattcattcatagtgtgaggcccagaaatcggcatttttaaacaagtacactggacatttctaaagctggctaaagtttgagagacactatccaagggaaatttctccgtaactctttttctcagaagaaaagtaaactaaaagtaaaaataagcagtaccactaagtttcaagtgatcttctcctaaaagaagaaaaggcctatattcaggcacaagaaaagtatattctcttttatccatgcagaaaacagctagtggttgaaaatcaacacttcagacctcttgtctacataaagccaactgcccctttgttttactgatgtcttcaatgattttacttagatttttctacggcatttactgaattagctaagcagacacagatccagtccttcatgaatatggtttgggactctctactgaatcagcactcttagcttcaccgacatagtctcttggt

SEQ ID NO: 373671 - DNA, 476 bp, Homo sapiens
cctcgcgggggcagcccaggggcacggccgctccgggggtcccctttcgtctggagaaacacagaggcccaccatcacctggccgcgccgtgcaggcctctgcgcggacccccgcccctgtctccaccttccccaggcctgcgggcacgtgaggcctggccacacggacccgggcggagggctgcgggggtgaagggagccccccgccccaattctgcacccctggcctcccgcctgcctccttgcggccgagcagcctccgctgcctccgcgcctcccgcccgcccggcgttcgtccgcaggctcggcccggctcctcctcccgaccccggtaatacgaaccgccggcggctaacgcggcctcgctccctctcgcaaacctctccctcctcctcctccccctcgcctcagctcctcctctcgggcgggagcgggtagccaggggtggagtgggggagggcggggaacgcggccgc

SEQ ID NO: 373672 - DNA, 1728 bp, Homo sapiens
agcgggctgcagggctgcgggcgcttggttcggcctggcccggccggcggctcctaacaccgggcgggcggctgcggcggcacttccgggttggccttctccatgttggtctcgggaacgtgaaggggcggggcctcgaggtcaggggtcagcacctccctggttgccgtggcgactggaggcgcgcgacgcgggcgcaatggcggggacccggggcttgatgctgcttgggcctggcccagtggcgggtcctagggacgtgggtacctgcagaggccggcagatggagattcagaaacataaggacaacaagaaacttccccaaggtatcattatagtctttagacttcagacacacaccacacctcaaatatatacacaactgaaaggaaaattaaggaagtttttcaaagaaccctattccgagtaagaagtgtgttgcatgaatttctaagagccagaaaatgcatgacacaggagaagatgtaccctcatctgttcagtgagagatgtgcaaatcaacatcaacacagaactgctgaagaaaaaaaatatgtgtgtggattatatatatacatataaggtgtgtatatatatatatatatatatttacatatatagtatgggctatttcacctttgcaagctgggagccattaagtaatggctaccaccactcccccacccccttcagtaaaacacatcctgaacattgggcccatgttttcaagaagaatgtgccccactgccccttggaaactccatttcatttacttggttcagttagttaatgacggtccattttgactcaaatatccagttccctttcatcaatcatgtctttctggactgtcagttttagggcaaggattacaaagcccttccatgcagatatccacagagaaagacccagacccacatccccatttaggattgcttagggactcatttcttccgcttccttccaaatgaaaagaatgagctatgtgaaaggggaaaaccccactggaaaatgaatgttggtgactcaagtgttaatctagaaagtcttatgatttggtgctggaaaagggcattgtaataagatggttctttataccatgcaaaccaggggaatacaaaacactgtcaaccatgaaaataagatttaatttggaatcacaacacatagggttttttccactttaaattctttttattcattcatatttgttataaatattcaatagaaatgcagtttttcaagactgaaatggtctttaatgaagcaagccatgtgtggcttttcaggcgagcattttcatgcttggttaactgtaaggatgttcatgttcctttcccaaaaaatatgatttgtgattctgcttaggtctctgaaaagcaacttattcactggagatgtgaggagccatccgcacatcacaattctatagacatcaaacgcatgaagcatttcggatctgctttaagactgaggcagactttccatctggacacagccgaccatccatgtgtcattacaatgaatccagcacttccctggaagctggaagggtcaaattcaacttcaactctgccacttcctgcttaacttgctgtttaaccttgggcaagctgccatcccacacgaggccgaaggtgtcggtttttaaaatacagaaattgggttccatgagggattatcaatatactgctggtgggccaaattccatctgctacttgcctttgt

SEQ ID NO: 373673 - DNA, 815 bp, Homo sapiens
agcgggctgcagggctgcgggcgcttggttcggcctggcccggccggcggctcctaacaccgggcgggcggctgcggcggcacttccgggttggccttctccatgttggtctcgggaacgtgaaggggcggggcctcgaggtcaggggtcagcacctccctggttgccgtggcgactggaggcgcgcgacgcgggcgcaatggcggggacccggggcttgatgctgcttgggcctggcccagtggcgggtcctagggacgtgggtacctgcagaggccggcagatggagattcagaaacataaggacaacaagaaacttccccaaggtatcattatagtctttagacttcagacacacaccacacctcaaatatatacacaactgaaaggaaaattaaggaagtttttcaaagaaccctattccgagtaagaagtgtgttgcatgaatttctaaggtctctgaaaagcaacttattcactggagatgtgaggagccatccgcacatcacaattctatagacatcaaacgcatgaagcatttcggatctgctttaagactgaggcagactttccatctggacacagccgaccatccatgtgtcattacaatgaatccagcacttccctggaagctggaagggtcaaattcaacttcaactctgccacttcctgcttaacttgctgtttaaccttgggcaagctgccatcccacacgaggccgaaggtgtcggtttttaaaatacagaaattgggttccatgagggattatcaatatactgctggtgggccaaattccatctgctacttgcctttgt

SEQ ID NO: 373674 - DNA, 915 bp, Homo sapiens
agcgggctgcagggctgcgggcgcttggttcggcctggcccggccggcggctcctaacaccgggcgggcggctgcggcggcacttccgggttggccttctccatgttggtctcgggaacgtgaaggggcggggcctcgaggtcaggggtcagcacctccctggttgccgtggcgactggaggcgcgcgacgcgggcgcaatggcggggacccggggcttgatgctgcttgggcctggcccagtggcgggtcctagggacgtgggtacctgcagaggccggcagatggagattcagaaacataaggacaacaagaaacttccccaaggtatcattatagtctttagacttcagacacacaccacacctcaaatatatacacaactgaaaggaaaattaaggaagtttttcaaagaaccctattccgagtaagaagtgtgttgcatgaatttctaagagccagaaaatgcatgacacaggagaagatgtaccctcatctgttcagtgagagatgtgcaaatcaacatcaacacagaactgctgaagaaaaaaaatatgtctctgaaaagcaacttattcactggagatgtgaggagccatccgcacatcacaattctatagacatcaaacgcatgaagcatttcggatctgctttaagactgaggcagactttccatctggacacagccgaccatccatgtgtcattacaatgaatccagcacttccctggaagctggaagggtcaaattcaacttcaactctgccacttcctgcttaacttgctgtttaaccttgggcaagctgccatcccacacgaggccgaaggtgtcggtttttaaaatacagaaattgggttccatgagggattatcaatatactgctggtgggccaaattccatctgctacttgcctttgt

SEQ ID NO: 373675 - DNA, 1776 bp, Homo sapiens
cctcgcgggggcagcccaggggcacggccgctccgggggtcccctttcgtctggagaaacacagaggcccaccatcacctggccgcgccgtgcaggcctctgcgcggacccccgcccctgtctccaccttccccaggcctgcgggcacgtgaggcctggccacacggacccgggcggagggctgcgggggtgaagggagccccccgccccaattctgcacccctggcctcccgcctgcctccttgcggccgagcagcctccgctgcctccgcgcctcccgcccgcccggcgttcgtccgcaggctcggcccggctcctcctcccgaccccgatggagattcagaaacataaggacaacaagaaacttccccaaggtatcattatagtctttagacttcagacacacaccacacctcaaatatatacacaactgaaaggaaaattaaggaagtttttcaaagaaccctattccgagtaagaagtgtgttgcatgaatttctaagagccagaaaatgcatgacacaggagaagatgtaccctcatctgttcagtgagagatgtgcaaatcaacatcaacacagaactgctgaagaaaaaaaatatgtgtgtggattatatatatacatataaggtgtgtatatatatatatatatatatttacatatatagtatgggctatttcacctttgcaagctgggagccattaagtaatggctaccaccactcccccacccccttcagtaaaacacatcctgaacattgggcccatgttttcaagaagaatgtgccccactgccccttggaaactccatttcatttacttggttcagttagttaatgacggtccattttgactcaaatatccagttccctttcatcaatcatgtctttctggactgtcagttttagggcaaggattacaaagcccttccatgcagatatccacagagaaagacccagacccacatccccatttaggattgcttagggactcatttcttccgcttccttccaaatgaaaagaatgagctatgtgaaaggggaaaaccccactggaaaatgaatgttggtgactcaagtgttaatctagaaagtcttatgatttggtgctggaaaagggcattgtaataagatggttctttataccatgcaaaccaggggaatacaaaacactgtcaaccatgaaaataagatttaatttggaatcacaacacatagggttttttccactttaaattctttttattcattcatatttgttataaatattcaatagaaatgcagtttttcaagactgaaatggtctttaatgaagcaagccatgtgtggcttttcaggcgagcattttcatgcttggttaactgtaaggatgttcatgttcctttcccaaaaaatatgatttgtgattctgcttaggtctctgaaaagcaacttattcactggagatgtgaggagccatccgcacatcacaattctatagacatcaaacgcatgaagcatttcggatctgctttaagactgaggcagactttccatctggacacagccgaccatccatgtgtcattacaatgaatccagcacttccctggaagctggaagggtcaaattcaacttcaactctgccacttcctgcttaacttgctgtttaaccttgggcaagctgccatcccacacgaggccgaaggtgtcggtttttaaaatacagaaattgggttccatgagggattatcaatatactgctggtgggccaaattccatctgctacttgcctttgt

SEQ ID NO: 373676 - DNA, 3073 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373677 - DNA, 2229 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagagga

SEQ ID NO: 373678 - DNA, 520 bp, Homo sapiens
ttatgacatgattacgtatttaacacccctcattataggtaagggggccctgaaggccaagaattcggcagacggtaagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373679 - DNA, 3006 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcactgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373680 - DNA, 2936 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgttttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373681 - DNA, 2940 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373682 - DNA, 2772 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccacacctacctttttgtacgggtggcctggcctgcatatattgctgagagcgaattacatatccaatcgacacttataatgaggtttatgagcgaacattc

SEQ ID NO: 373683 - DNA, 3032 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373684 - DNA, 4035 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacagcaggtcaggatagatgggctgctcctctttcccccgcctcccgtgagccccgtatgcttcctcctctctggtctgaggaacctccctccccccacccctccccgtggtcttcaggaactttgtctcctgcctgtgcaggttgaggaaggtagttgcaggccaggccagaaggccagcctcatcatcttttctgcagtagaaattggtgataagggctgcatccctcccttggttcaaagaggcttccacccccagccttttttttcttgggagttggtggcatttgaaggtgtttgcggacaaaactgggaggaacagggcctccaggcagtgaaagcactgcttggacatttgttacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcaaagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373685 - DNA, 2952 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373686 - DNA, 3981 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacagcaggtcaggatagatgggctgctcctctttcccccgcctcccgtgagccccgtatgcttcctcctctctggtctgaggaacctccctccccccacccctccccgtggtcttcaggaactttgtctcctgcctgtgcctgcagtagaaattggtgataagggctgcatccctcccttggttcaaagaggcttccacccccagccttttttttcttgggagttggtggcatttgaaggtgtttgcggacaaaactgggaggaacagggcctccaggcagtgaaagcactgcttggacatttgttacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcaaagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373687 - DNA, 3981 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacagcaggtcaggatagatgggctgctcctctttcccccgcctcccgtgagccccgtatgcttcctcctctctggtctgaggaacctccctccccccacccctccccgtggtcttcaggaactttgtctcctgcctgtgcaggttgaggaaggtagttgcaggccaggccagaaggccagcctcatcatcttttctgcagtagaaattggtgataagggctgcatccctcccttggttcaaagaggcttccacccccagccttttttttcttgggagttggtggcatttgaaggtgtttgcggactacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcaaagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373688 - DNA, 4395 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggtgagggaaggagggcgagcgagcaggccggcggctggccggccgggtcactggaggcccagagctcgggcgagcgggtggcaggcggggggtggggttgggcggggaataacgtggctggggccgggtcgggccggggatgggtcagcgatcactacaaggggcccgactggcttgattcgggcgtcacgggtgcctagtgttgttctagagagggtagcttttcttttatcacgaccctcgcatggggcgagggaaatggccgagcatggctgaggccgcgctctggccgagagcagggcacagcccctgcgttggttcctcttaagctgtcctccataccctccccacttatattaggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacagcaggtcaggatagatgggctgctcctctttcccccgcctcccgtgagccccgtatgcttcctcctctctggtctgaggaacctccctccccccacccctccccgtggtcttcaggaactttgtctcctgcctgtgcaggttgaggaaggtagttgcaggccaggccagaaggccagcctcatcatcttttctgcagtagaaattggtgataagggctgcatccctcccttggttcaaagaggcttccacccccagccttttttttcttgggagttggtggcatttgaaggtgtttgcggacaaaactgggaggaacagggcctccaggcagtgaaagcactgcttggacatttgttacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcaaagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373689 - DNA, 4243 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggatcccaaaacgaaccaacagaccaggcatcagcacaacagacgagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaagtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacagcaggtcaggatagatgggctgctcctctttcccccgcctcccgtgagccccgtatgcttcctcctctctggtctgaggaacctccctccccccacccctccccgtggtcttcaggaactttgtctcctgcctgtgcaggttgaggaaggtagttgcaggccaggccagaaggccagcctcatcatcttttctgcagtagaaattggtgataagggctgcatccctcccttggttcaaagaggcttccacccccagccttttttttcttgggagttggtggcatttgaaggtgtttgcggacaaaactgggaggaacagggcctccaggcagtgaaagcactgcttggacatttgttacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcaaagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373690 - DNA, 2601 bp, Homo sapiens
ttttggtggtggtagccttgtgcctccctttgtgcctgttataattgtgttgctctttgttcttagtctacgtctatctttctttgtagaggttgcgtgctcgcatttgaccttcaaatctaatagtttttcctccaattggagacgctttaggattctaagagaaagcaagctgcaaggggtttcccctttaatctagaaatgtggagtctcagcccacttaattttgctcactcttaaaagcatttcaaccaaagccattcattagggatttgatttggaggcaggagggattcctatactgttttaactggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacagcaggtcaggatagatgggctgctcctctttcccccgcctcccgtgagccccgtatgcttcctcctctctggtctgaggaacctccctccccccacccctccccgtggtcttcaggaactttgtctcctgcctgtgcaggttgaggaaggtagttgcaggccaggccagaaggccagcctcatcatcttttctgcagtagaaattggtgataagggctgcatccctcccttggttcaaagaggcttccacccccagccttttttttcttgggagttggtggcatttgaaggtgtttgcggacaaaactgggaggaacagggcctccaggcagtgaaagcactgcttggacatttgttacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcaaagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373691 - DNA, 2343 bp, Homo sapiens
ttgtgggctgatctagaggatcccagatgaatatgagtcacctccaggcatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacagcaggtcaggatagatgggctgctcctctttcccccgcctcccgtgagccccgtatgcttcctcctctctggtctgaggaacctccctccccccacccctccccgtggtcttcaggaactttgtctcctgcctgtgcaggttgaggaaggtagttgcaggccaggccagaaggccagcctcatcatcttttctgcagtagaaattggtgataagggctgcatccctcccttggttcaaagaggcttccacccccagccttttttttcttgggagttggtggcatttgaaggtgtttgcggacaaaactgggaggaacagggcctccaggcagtgaaagcactgcttggacatttgttacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcaaagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373692 - DNA, 1946 bp, Homo sapiens
  misc_feature (1)..(1): n is a, c, g, or t
ngctgtgtgctgtctgataaaaggccacaggacagctgtgaggtagagctggtgaaggcacttttgagtgcaggtcaggatagatgggctgctcctctttcccccgcctcccgtgagccccgtatgcttcctcctctctggtctgaggaacctccctccccccacccctccccgtggtcttcaggaactttgtctcctgcctgtgcaggttgaggaaggtagttgcaggccaggccagaaggccagcctcatcatcttttctgcagtagaaattggtgataagggctgcatccctcccttggttcaaagaggcttccacccccagccttttttttcttgggagttggtggcatttgaaggtgtttgcggacaaaactgggaggaacagggcctccaggcagtgaaagcactgcttggacatttgttacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcaaagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373693 - DNA, 2589 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggtgagggaaggagggcgagcgagcaggccggcggctggccggccgggtcactggaggcccagagctcgggcgagcgggtggcaggcggggggtggggttgggcggggaataacgtggctggggccgggtcgggccggggatgggtcagcgatcactacaaggggcccgactggcttgattcgggcgtcacgggtgcctagtgttgttctagagagggtagcttttcttttatcacgaccctcgcatggggcgagggaaatggccgagcatggctgaggccgcgctctggccgagagcagggcacagcccctgcgttggttcctcttaagctgtcctccataccctccccacttatattaggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagagga

SEQ ID NO: 373694 - DNA, 444 bp, Homo sapiens
gtccttctccaggcgaggctactgcccaggcgaggtactgccaggcgaggctacctgccctggcgaggtgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373695 - DNA, 310 bp, Homo sapiens
gtaagcctatgtccattgctgttctagttgtgtataaactctccaggttgcctttaaggctatcatttgttcatctctgactcagtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacagcaggtcaggatagatgggctgctcctctttcccccgcctcccgtgagccccgtatgcttcctcctctctggtct

SEQ ID NO: 373696 - DNA, 3107 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataaaaattgtttggccttttgggtgtaaaaaaaaaaa

SEQ ID NO: 373697 - DNA, 3033 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373698 - DNA, 1693 bp, Homo sapiens
tcactttatttattcattctcctccaacattagcataattaaagcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373699 - DNA, 3102 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcactgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataacaacccaggtccacacaaccttctgtcgagcccccaaatcggaaccttctgggtttcgtaaggataccctgtccctcatgctggcttagctgtgtt

SEQ ID NO: 373700 - DNA, 2628 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaaaagaattaaaaaaaaaaaaaacacactttgtccggccgcgcgcctgtgggccctctggaaaaacgtttctctaaacccaatccggtggggcgcccggggccccattgggatacggtagcacctggggcccaaaagcgcgggtcccccaaaggagaaaccccggggccaggagcacaagggcgctgggggctctctccaccacaattaaaaaaagcgcgccgcgcggggggacacacgcgaggcgcgttttcgtgaaacaaatctctccaggagaggggagattcccggggggggcccacatacaggggaatctcttatctaacgcggggatctcaagagggaagcctgcgaaatttctcaattttagcccg

SEQ ID NO: 373701 - DNA, 2286 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
  misc_feature (2270)..(2271): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaagtcgacgcggccgnnaatttagtagtagta

SEQ ID NO: 373702 - DNA, 3433 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggtgagggaaggagggcgagcgagcaggccggcggctggccggccgggtcactggaggcccagagctcgggcgagcgggtggcaggcggggggtggggttgggcggggaataacgtggctggggccgggtcgggccggggatgggtcagcgatcactacaaggggcccgactggcttgattcgggcgtcacgggtgcctagtgttgttctagagagggtagcttttcttttatcacgaccctcgcatggggcgagggaaatggccgagcatggctgaggccgcgctctggccgagagcagggcacagcccctgcgttggttcctcttaagctgtcctccataccctccccacttatattaggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373703 - DNA, 1541 bp, Homo sapiens
aatgtagagttggtacttgtgacttataaaaatgctttaaagaaggatagggagagcttagaagataatttctagtcaagggaaatcaagaagtcttgcttagaaaaagagacattagaatgtcagtaagttggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373704 - DNA, 2815 bp, Homo sapiens
ttttggtggtggtagccttgtgcctccctttgtgcctgttataattgtgttgctctttgttcttagtctacgtctatctttctttgtagaggttgcgtgctcgcatttgaccttcaaatctaatagtttttcctccaattggagacgctttaggattctaagagaaagcaagctgcaaggggtttcccctttaatctagaaatgtggagtctcagcccacttaattttgctcactcttaaaagcatttcaaccaaagccattcattagggatttgatttggaggcaggagggattcctatactgttttaagtgtgtattaattctttcaatttattgaatatttagtgagtacctgctatgcactaggcactattctcggttgtgggtacagcagggaacagcacagaccaaaatctttgccttcactgagcttatgggatagtgctggtggtggaagtgcaacatattggtcaagtagaaaacaagtgtgtggtttttgtaaaaaattattttttcctgatagctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacagcaggtcaggatagatgggctgctcctctttcccccgcctcccgtgagccccgtatgcttcctcctctctggtctgaggaacctccctccccccacccctccccgtggtcttcaggaactttgtctcctgcctgtgcaggttgaggaaggtagttgcaggccaggccagaaggccagcctcatcatcttttctgcagtagaaattggtgataagggctgcatccctcccttggttcaaagaggcttccacccccagccttttttttcttgggagttggtggcatttgaaggtgtttgcggacaaaactgggaggaacagggcctccaggcagtgaaagcactgcttggacatttgttacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcaaagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373705 - DNA, 2295 bp, Homo sapiens
agtagtcgatctaaggatccccttccaaagcggagatgcgaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacagcaggtcaggatagatgggctgctcctctttcccccgcctcccgtgagccccgtatgcttcctcctctctggtctgaggaacctccctccccccacccctccccgtggtcttcaggaactttgtctcctgcctgtgcaggttgaggaaggtagttgcaggccaggccagaaggccagcctcatcatcttttctgcagtagaaattggtgataagggctgcatccctcccttggttcaaagaggcttccacccccagccttttttttcttgggagttggtggcatttgaaggtgtttgcggacaaaactgggaggaacagggcctccaggcagtgaaagcactgcttggacatttgttacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcaaagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373706 - DNA, 2493 bp, Homo sapiens
attttgagatcgtatgcctcatttcggagccttataagtcagtttttgacagtcacttagtcaacaagtttgaatgaacatgccttctgaatccttcccagcagtccccacaacttcatgtacctatcagcactctccccagcagtaccattgagcacgtcaacccacacaagcaaccaaagcagcctgtccaacagtcattggcagtggcctcaacaccacaggcagtaattcggttgcacaggtctcactgtctcacccccagatgcacacacagccatctccacatccgtccccatcgaccgcatggtttaccgcagcatccgcagcgttcccccaaccgcatcacccgttcaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacagcaggtcaggatagatgggctgctcctctttcccccgcctcccgtgagccccgtatgcttcctcctctctggtctgaggaacctccctccccccacccctccccgtggtcttcaggaactttgtctcctgcctgtgcaggttgaggaaggtagttgcaggccaggccagaaggccagcctcatcatcttttctgcagtagaaattggtgataagggctgcatccctcccttggttcaaagaggcttccacccccagccttttttttcttgggagttggtggcatttgaaggtgtttgcggacaaaactgggaggaacagggcctccaggcagtgaaagcactgcttggacatttgttacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcaaagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373707 - DNA, 3191 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacagcaggtcaggatagatgggctgctcctctttcccccgcctcccgtgagccccgtatgcttcctcctctctggtctgaggaacctccctccccccacccctccccgtggtcttcaggaactttgtctcctgcctgtgcaggttgaggaaggtagttgcaggccaggccagaaggccagcctcatcatcttttctgcagtagaaattggtgataagggctgcatccctcccttggttcaaagaggcttccacccccagccttttttttcttgggagttggtggcatttgaaggtgtttgcggacaaaactgggaggaacagggcctccaggcagtgaaagcactgcttggacatttgttacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcaaagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagagga

SEQ ID NO: 373708 - DNA, 2958 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcagggccgggctagagcgacatcatggtattccccttactaaaaaaagtgtgtattaggaggagagagaggaaaaaaagaggaaagaaggaaaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataa

SEQ ID NO: 373709 - DNA, 2135 bp, Homo sapiens
  misc_feature (9)..(10): n is a, c, g, or t
  misc_feature (12)..(12): n is a, c, g, or t
  misc_feature (61)..(61): n is a, c, g, or t
  misc_feature (150)..(150): n is a, c, g, or t
  misc_feature (181)..(181): n is a, c, g, or t
aatgaaggnngncacccaaatccccaatcaatgcctgttcaatcaacaaacatctaacagnacattatgtggtagcatattgccaggccgtgagatgcgaatataaataggaaccgcccctcatctgcaggcgctcacaacctagttagnaaacagtaaaacaattaagcgcgccgtgganataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggatcccaaaacgaaccaacagaccaggcatcagcctccatcttctcctcaatggacatgatcaccgggccagcattgcctggaggtggactcatattcatctgcttctctacctcgttctgtagctcc

SEQ ID NO: 373710 - DNA, 1396 bp, Homo sapiens
tttttttttaactgaaaaacaaacacccttgagtttttcagttcaccttttgttaaggagcagagcctgcatatatatgtaaatgtctcaatgataaaaaaaaaaatgtaaacatggattggcattaatttgcaagcagaatcttaatagcctgatgggttttttgtttgtttttttcttctagatgaagttaaacgttcgttttcaccttacgatgggaacaactgtagtgcaggcggctctgcctctatttgccactcttggccctcttgctattaagggaaaggctttgaagagcacagcactgacagggctgtaaagatggaaggagctggtatttttaccatgcgtagattcccaagagaacttgtactaaaaagcagaaagttacaaggaagcagaattaggccaacatttccagcaattaaaacaatgatgggaaactccaatccatgaggaggctggtcagtcacctcaaggatactggcctaaagaagtctgaagtggctgatgtccataacttctgagtctgtttccaaaagaaagactcttgttaatgctgttaccagagagtagagatttgaccagcctctccctaaaatgtaagcttctcaacaacagtacaggaagaagtgcaagagtagactagaacctttaaggaatttggggctggaacggagctatgttgcatctgttgttatacaggtagattataagttctacatgcaccagccaaaacttaggacaggatgtccccaaattaagatactacagattaccaaatcagaaataaccagctggatttaggccagctcacatttatttggaaattaccctccctgattaacaggcttctgagttgtacgtggaggactaatgagacttgtacaagacaccacggggcttggggtccaggtcccagttggatatcggaacagacacagataagtgtgtttcctcattaaggtggtgagagtgtgccttttggcattcagaaaagggtttagccaccctaagagttggaaataaagattcccaactggaaatgttgcagaatccctacaagtgtctcaataaaagccattttaaaagaatattgttgctactgtttgcttttcaaataatctggagatcgttggctatggcaacgtgctgccacctaattagagaatgcctgtaaatgtaggctgaacacttctaacatgagaaaacctaagtatcctacagaggtttggtgtgttttgtttttgtgggtgtcgggggaagggggtggggaggcgtgtttttggccctgcaggttttctcgtgggaatgagttcactcagacaagctaggactgtggcttctttccctgttcatcacatagagcattttctcatcctatctttggttcctt

SEQ ID NO: 373711 - DNA, 1088 bp, Homo sapiens
tttttttttaactgaaaaacaaacacccttgagtttttcagttcaccttttgttaaggagcagagcctgcatatatatgtaaatgtctcaatgataaaaaaaaaaatgtaaacatggattggcattaatttgcaagcagaatcttaatagcctgatgggttttttgtttgtttttttcttctagatgaagttaaacgttcgttttcaccttacgatgggaacaactgtagtgcaggcggctctgcctctatttgccactcttggccctcttgctattaagggaaaggctttgaagagcacagcactgacagggctgtaaagatggaaggagctggtatttttaccatgcgtagattcccaagagaacttgtactaaaaagcagaaagttacaaggaagcagaattaggccaacatttccagcaattaaaacaatgatgggaaactccaatccatgaggaggctggtcagtcacctcaaggatactggcctaaagaagtctgaagtggctgatgtccataacttctgagtctgtttccaaaagaaagactcttgttaatgctgttaccagagagtagagatttgaccagcctctccctaaaatgtaagcttctcaacaacagtacaggaagaagtgcaagagtagactagaacctttaaggaatttggggctggaacggagctatgttgcatctgttgttatacaggtagattataagttctacatgcaccagccaaaacttaggacaggatgtccccaaattaagatactacagattaccaaatcagaaataaccagctggatttaggccagctcacatttatttggaaattaccctccctgattaacaggcttctgagttgtacgtggaggactaatgagacttgtacaagacaccacggggcttggggtccaggtcccagttggatatcggaacagacacagataagtgtgtttcctcattaaggtggtgagagtgtgccttttggcattcagaaaagggtttagccaccctaagagttggaaataaagattcccaactggaaatgttgcagaatccctacaagtgtctcaataaaagccatttta

SEQ ID NO: 373712 - DNA, 891 bp, Homo sapiens
aaagccttgagagagcgttttcaaggatcaggagagggcttagaaagaaaaggactctgagtggggctgcatgaaaagggggtaagtgaggactcttggggagggtctgaaaaaaacaagtagtttggcaaggagagcagaaaaataaaattccactgtgtaggcatttggagatttagcaagagcaacctagagtctgcccccagagacactgcacgttgtttctgacacagaggatgcactaattctatttcctgtgccacctgaaaaaatcataatttgagaagagaaactgttaggccatttctagtgaactatttttccaaaccctcacggaaccctgaacagggtgtgaatgagatcacaactactgctgctgctggttcagcctctctgtccactaataaaggcaaacccttcagcatggtcatatcctgccagccgttttcccccaaaagattaaattatgttcatcttggctcatctaacgccacatcttgagttcttaaggtatcacagccaactcagtcataccttactttatgcactgagtacgcattaaactctatttaggaaggaagagggaagcaaaggaagccagggatggttttgtcatgacctctctttgctttctgacctcccggaatccactctttggaagatgtgcagaaaacaatgtgacttccatttaccctgcctcagatctcccctccttcagactggctcccacccctggttaatggggtaacctgggtacgcctatttgttaaaggaatttgtgggaagtgaggggcaaaattgttggagcagagggaatagatttatgggagctttgttacccagtgactatcccagcattaatacttcagagtagccctgacgcttgtggaa

SEQ ID NO: 373713 - DNA, 351 bp, Homo sapiens
atattactgacagcatgtgacagagatatggagcatttagagaaaattaaccacaagatacacagaaagccagacaactaaaaaatgaggtctgttgggattactatcttaatgaatttctggatagctggttcaagacggcgtaatttcactttttcttcatcttcagacatcctaaaaaaatgttgtatgacctccctggtaacagctgtcttctccactcatatagaaaaacctaaaagaaaaatatttctttaagaatgttttcaaatctgtttccactatttttaaaagccaacgattagttttacaatttattctaaatcaataaatagaatatttctaatgctg

SEQ ID NO: 373714 - DNA, 332 bp, Homo sapiens
agtagggtgagggaaatggttaagatgggagggttcccgggcccgcagctctagtactggccgggcatacgtctgttgggattactatcttaatgaatttctggatagctggttcaagacggcgtaatttcactttttcttcatcttcagacatcctaaaaaaatgttgtatgacctccctggtaacagctgtcttctccactcatatagaaaaacctaaaagaaaaatatttctttaagaatgttttcaaatctgtttccactatttttaaaagccaacgattagttttacaatttattctaaatcaataaatagaatatttctaatgctg

SEQ ID NO: 373715 - DNA, 326 bp, Homo sapiens
  misc_feature (60)..(60): n is a, c, g, or t
taaggtgttgttagattataaatattctaaaacaacaaaaaaccctagtgctgaacgggnatacgtctgttgggattactatcttaatgaatttctggatagctggttcaagacggcgtaatttcactttttcttcatcttcagacatcctaaaaaaatgttgtatgacctccctggtaacagctgtcttctccactcatatagaaaaacctaaaagaaaaatatttctttaagaatgttttcaaatctgtttccactatttttaaaagccaacgattagttttacaatttattctaaatcaataaatagaatatttctaatgctg

SEQ ID NO: 373716 - DNA, 324 bp, Homo sapiens
gatatttgcccgaaataaaggtggagaatatacctgctttaagtaaactgaagattttaaagtatagattcatatacttgacttctttaagatttttcaagaagatttagcagttcctctaatacatttaaaatatgatttgactacagaaattttgttaatattttgacatatcttttagccttctatgtgtaatcatacacaaacatgttatttacaaaaatggtattatgtagtatatgctgttttgaaaccttacacatatatctttatatttattgtggttgttattctatatcaataaaatctactttccccttaaaa

SEQ ID NO: 373717 - DNA, 1118 bp, Homo sapiens
tccagttttatggagggtggaagcctcacttccttggctataataaagagttctgatgcatcttcatacaacaagaggaagagtctgcacgcagaagcaccaccttctagggataaataaagggtcaagctaaggaagggcagaacaaacttcagacactcacttctttgcctcaacttcagcctgctctcacaacctcactatgtcttgccccaactactgctcgggaaactccaactcaggatctctcagaacctcccgccatattcctctcacctccatcgacctctgccctaccagcgtgagctgtggagatgtcctctacttacccactagctctcaagaccatacctgggtcacagacaactgccaagagacctgcggtgaaccaaccagctgccagccggtccactgtgagaccggcaatcttgaaacctcttgcggttcttccactgcttactacgtgcccaggccttgccaaggaagcagttttcttcctgcttctttcttctccagttcctgccttccagtatcctgtagaccacagaggtatgtgtccagcggctgtcgtccactgaggccgctgctcaatagttaccagcccataggagactgtgtgcccaatgcctatcgcccccaattctgcttgtccaagagttgccagccccaaaacctcctcacttctggatgccaaccctcgagttgcttggcctatcgtcctcaaagtcttcacgttgtgtccagcagcctcagacctctggggcctctgttcagtggttgccaacctctgacccatgtgttcagcacgtgtcgtccatcttgctctggactgtgaaaccagcagcttctttgttccagtgaataatcactctgagcatccacaacaaaaattcaaactccatggacttttgcttctttgctagtagcaactgatgtttcttagttttactgtgcctgatctaatgcaagctgcttctctcgcatgttttatcttgttttcatctttccttgacatcaaaaaaattagtttacaatgctattcaatgttgctctggtctgggaagaatgtatttgttttgcactataataaatgcgattaagtccaaataagaatctgg

SEQ ID NO: 373718 - DNA, 540 bp, Homo sapiens
gcctgtgcttaccacgttaaccactcattgtgtttctgaagtttattaagaacaggcacaaagtcagaatcaatctgcaaatttacttctcattcctcattattaaaatataaaatgagtttctattaatttttcttagtttctttatagatactgatataattcataataataccattcttatcttaaaaccttgtcacacacaatgaaactttgctgttcactgtcagttataacttacatgaggtgacccatttccattcaagggttttagaagcacatcaaggacattctaaggatgattgacttacacaatgatctctgaacatgcctcctgccttctcctcactcttgagtatttgcttaggggagcagaaaaaatactggtagcattactgtaacattttaattctgctttatttaaaaaagacatagctggcatatagttaagtactgaaaaatgttagctactcagttatgtataatgctagtattttgttttgaataaagttgacattaatgatcatattattaattgta

SEQ ID NO: 373719 - DNA, 259 bp, Homo sapiens
taatttccaaggagcagcattaggggtgtgaatggtacttaaagtgtgtggatttaaagtagacagaagaatcaatatattctcctcagcagtgccagtcccagctcccacactgatctgctgtaaggatgttgcctctatcccaagccccattttagtgcaacaatttggaaactgacgggaatgtggggggccaataggaaccgtgtcttgattagacatgtgctggcctgagagacaacattctcttctgccagga

SEQ ID NO: 373720 - DNA, 437 bp, Homo sapiens
ctcgaaggcccaaaccagcagcctcttgtttgtaacgactgggatgagcatggaatctgactgcagacgttatctctggacctcatctggcagagagatgaagctcagtaggcagaactgaatgaggaaatcacccaaacaagccatagatgtaagaagcggccagttggcaaggaagagtggtctggcaggtgcggtggctcacacctataatctcagcactctgggaggccgaggaggatcacttgaggccaggagttcgagaccagcctggccaacatggcaaaccctgtccctattaaaaaatataaaaattaggcagatgtggtgatgcatgcctgtaatcccagctacctgagaggctgaggcatgagactcacttgaacccaggaggtagaggttgcagtggcccgagatcacaccactgcactccagcc

SEQ ID NO: 373721 - DNA, 328 bp, Homo sapiens
agacggagtctcactctgtcgtctaggctggagtgcagtggcgcgatctcggctcactgcaagctccgcctcccgggttcacaccattttcctgcctcagcctccccagcatctgggactacaggcttccgccaccacgcccagctaattttttgtatttttagtagagactgggtttcattgtgttagccaggatggtctcgatctcctgacctcatgatccgcccacctcggcctcccaaagtgctgggattacaggcgtgagcgaccgtgaccggccactatcttctcgcttaatagcataattagaagataaaatttgttataa

SEQ ID NO: 373722 - DNA, 483 bp, Homo sapiens
catggccatctgctttttctaatgattaagacagaaagataatgatgcaatgaagtaaatgcatgctcatctgctcctcatattagctaggcagaggtgtgatctccactttatggttggaaaaaaactgatgttcggagaagttaaataatttacaagactcgtagttcgttattcttattccaagtccactgctcatgttcccaagctgccctaggccagagcctgcttcacatttagcagactaagggtcctttttcaagtgccattttggtcaaggttaaataaatatggttttctccaatgcggatagggaattgataatgaggatgatttgtaacaaatgattaaacgggctattcacttggggagtctcctccctcttcccctttcatgtggctttcaaaagttaaaaggtgctggttgaaggtgggagcgacatcactttccttgaagagaaagaagctttatctccacacccct

SEQ ID NO: 373723 - DNA, 718 bp, Homo sapiens
ctctgcgccacgctccatggaggcgccaaggagaaggcctgggaagggaagagtgaaccttccctggtggagggcccactcctcaggcagtggggagaccgccttttgcatgcgacaggacttaccagttactattggcaccggaaccaccatctgagatacaggagaagacagaaatggaagcaaaggaagatggaaaaatagaaaacagagacccccaagaggttgaacagcttgccgagaatcatgaccagttgggaggccagttctgacaccagaggtcctgacggccaggccagcactgttttctgtagacatggtatcttctaaaaggcatttatcattttttttcctttcagaattaaatgaagactaaactcctgtacacgtgtttgttggtagaggccatcacagaatatggccaccatactgtgatctgccaacccaattaagatactggccatggcttctaatttgtgttttacactgttcagacataaatatttaaaatttgttgcattgcaatctgtttggttgtaaagatttgacctatgaagcaagaagtgttcatgaatgaggtttaaggatgtcaggggtgactcagaaggaaacgcgctagaacagcaaggatcagggaagcagcgcttttctctttgcaagtcataaaatacaatgcctgaaagagctaataagccttgttatctaatcatgtctaata

SEQ ID NO: 373724 - DNA, 378 bp, Homo sapiens
attttgtcatgaggctgtttttccccctggtaatttacaacctaattctgaaaatagtaatttggtctctaccagttcactctaaggaggaattgccctgtttctccccaccgctcatctcggactctgacgtcctctgcttccagcactgtctctttcccggagtctctactggggcgctccgggtgtgcagaagtattggacaaatggtcagtggagcaatagtgacgaaataaccctgctcctggctttgcggccaaggagaaaagctcagccgggaagggcacgggcagggaagccgggctctcctggcccggccggccccgccctggctcggcctgccttgggcgtccccctcccaggggacaggtgcggccg

SEQ ID NO: 373725 - DNA, 3725 bp, Homo sapiens
  misc_feature (3718)..(3724): n is a, c, g, or t
gacccacagcctggcacccttcggcgagcgctgtttgtttagggctcggtgagtccaatcaggagcccaggctgcagttttccggcagagcagtaagaggcgcctcctctctcctttttattcaccagcagcgcggcgcagaccccggactcgcgctcgcccgctggcgccctcggcttctctccgcgcctgggagcaccctccgccgcggccgttctccatgcgcagcgcccgcccgaggagctagacgtcagcttggagcggcgccggaccgtggatggccttgactgacggcggctggtgcttgccgaagcgcttcggggccgcgggtgcggacgccagcgactccagagcctttccagcgcgggagccctccacgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggaggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtgccttcatcacggcggcttggattgtcctgtgccaactgtcacaccacaactaccaccttatggcgcagaaacgccgagggtgaacccgtgtgcaatgcttgtggactctacatgaaactccatggggtgcccagaccacttgctatgaaaaaagagggaattcaaaccaggaaacgaaaacctaagaacataaataaatcaaagacttgctctggtaatagcaataattccattcccatgactccaacttccacctcttctaactcagatgattgcagcaaaaatacttcccccacaacacaacctacagcctcaggggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcagtccagacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaatttttttttttgaatgggatgtcctatggaaacctatttcaccagagttttaaaaataaaaagggtattgttttgtcttctgtacagtgagttccttcccttttcaaagctttctttttatgctgtatgtgactatagatattcatataaaacaagtgcacgtgaagtttgcaaaatgctttaaggccttcctttcaaagcatagtccttttggagccgttttgtaccttttataccttggcttatttgaagttgacacatggggttagttactactctccatgtgcattggggacagtttttataagtgggaaggactcagtattattatatttgagatgataagcattttgtttgggaacaatgcttaaaaatattccagaaagttcagattttttttctttgtgaatgaaatatattctggcccacgaacagggcgatttcctttcagttttttccttttgcaacgtgccttgaagtctcaaagctcacctgaggttgcagacgttacccccaacagaagataggtagaaatgattccagtggcctctttgtattttcttcattgttgagtagatttcaggaaatcaggaggtgtttcacaatacagaatgatggcctttaactgtgannnnnnna

SEQ ID NO: 373726 - DNA, 1440 bp, Homo sapiens
  misc_feature (1433)..(1439): n is a, c, g, or t
gtgggtgatctagaggatcccaatcagtttacacaaaaaaaagattttgcattttgtccaaaatcatgtgcttcttctgatcaattttggttgttccagaatttcttcataccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaatttttttttttgaatgggatgtcctatggaaacctatttcaccagagttttaaaaataaaaagggtattgttttgtcttctgtacagtgagttccttcccttttcaaagctttctttttatgctgtatgtgactatagatattcatataaaacaagtgcacgtgaagtttgcaaaatgctttaaggccttcctttcaaagcatagtccttttggagccgttttgtaccttttataccttggcttatttgaagttgacacatggggttagttactactctccatgtgcattggggacagtttttataagtgggaaggactcagtattattatatttgagatgataagcattttgtttgggaacaatgcttaaaaatattccagaaagttcagattttttttctttgtgaatgaaatatattctggcccacgaacagggcgatttcctttcagttttttccttttgcaacgtgccttgaagtctcaaagctcacctgaggttgcagacgttacccccaacagaagataggtagaaatgattccagtggcctctttgtattttcttcattgttgagtagatttcaggaaatcaggaggtgtttcacaatacagaatgatggcctttaactgtgannnnnnna

SEQ ID NO: 373727 - DNA, 495 bp, Homo sapiens
gtgcagaagtattggacaaatggtcagtggagcaatagtgacgaaataaccctgctcctggctttgcggccaaggagaaaagctcagccgggaagggcacgggcagggaagccgggcaccggggctgggggccggggtccccggggtgacgcggggagggacgggtccggcgcgcccactcccgccctcacgcaccgctgtcgccgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtggtgagtgtgacccgccctgcccctggctcgcggccggccccgggctctcctggcccggccggccccgccctggctcggcctgccttgggcgtccccctcccaggggacaggtgcggccg

SEQ ID NO: 373728 - DNA, 3779 bp, Homo sapiens
  misc_feature (3772)..(3778): n is a, c, g, or t
gacccacagcctggcacccttcggcgagcgctgtttgtttagggctcggtgagtccaatcaggagcccaggctgcagttttccggcagagcagtaagaggcgcctcctctctcctttttattcaccagcagcgcggcgcagaccccggactcgcgctcgcccgctggcgccctcggcttctctccgcgcctgggagcaccctccgccgcggccgttctccatgcgcagcgcccgcccgaggagctagacgtcagcttggagcggcgccggaccgtggatggccttgactgacggcggctggtgcttgccgaagcgcttcggggccgcgggtgcggacgccagcgactccagagcctttccagcgcgggagccctccacgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggaggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtgccttcatcacggcggcttggattgtcctgtgccaactgtcacaccacaactaccaccttatggcgcagaaacgccgagggtgaacccgtgtgcaatgcttgtggactctacatgaaactccatggggtgcccagaccacttgctatgaaaaaagagggaattcaaaccaggaaacgaaaacctaagaacataaataaatcaaagacttgctctggtaatagcaataattccattcccatgactccaacttccacctcttctaactcagatgattgcagcaaaaatacttcccccacaacacaacctacagcctcaggggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcagtccagacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccaaaatcatgtgcttcttctgatcaattttggttgttccagaatttcttcataccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaatttttttttttgaatgggatgtcctatggaaacctatttcaccagagttttaaaaataaaaagggtattgttttgtcttctgtacagtgagttccttcccttttcaaagctttctttttatgctgtatgtgactatagatattcatataaaacaagtgcacgtgaagtttgcaaaatgctttaaggccttcctttcaaagcatagtccttttggagccgttttgtaccttttataccttggcttatttgaagttgacacatggggttagttactactctccatgtgcattggggacagtttttataagtgggaaggactcagtattattatatttgagatgataagcattttgtttgggaacaatgcttaaaaatattccagaaagttcagattttttttctttgtgaatgaaatatattctggcccacgaacagggcgatttcctttcagttttttccttttgcaacgtgccttgaagtctcaaagctcacctgaggttgcagacgttacccccaacagaagataggtagaaatgattccagtggcctctttgtattttcttcattgttgagtagatttcaggaaatcaggaggtgtttcacaatacagaatgatggcctttaactgtgannnnnnna

SEQ ID NO: 373729 - DNA, 3223 bp, Homo sapiens
gacccacagcctggcacccttcggcgagcgctgtttgtttagggctcggtgagtccaatcaggagcccaggctgcagttttccggcagagcagtaagaggcgcctcctctctcctttttattcaccagcagcgcggcgcagaccccggactcgcgctcgcccgctggcgccctcggcttctctccgcgcctgggagcaccctccgccgcggccgttctccatgcgcagcgcccgcccgaggagctagacgtcagcttggagcggcgccggaccgtggatggccttgactgacggcggctggtgcttgccgaagcgcttcggggccgcgggtgcggacgccagcgactccagagcctttccagcgcgggagccctccacgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggaggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtgccttcatcacggcggcttggattgtcctgtgccaactgtcacaccacaactaccaccttatggcgcagaaacgccgagggtgaacccgtgtgcaatgcttgtggactctacatgaaactccatggggtgcccagaccacttgctatgaaaaaagagggaattcaaaccaggaaacgaaaacctaagaacataaataaatcaaagacttgctctggtaatagcaataattccattcccatgactccaacttccacctcttctaactcagatgattgcagcaaaaatacttcccccacaacacaacctacagcctcaggggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcagtccagacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccaaaatcatgtgcttcttctgatcaattttggttgttccagaatttcttcataccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaatttttttttttgaatgggatgtcctatggaaacctatttcaccagagttttaaaaataaaaagggtattgttttgtcttctgt

SEQ ID NO: 373730 - DNA, 454 bp, Homo sapiens
gcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcaggtaagggtcgcgcctcaggttcggggtgcgggtccaaagcgctggggcgcacgggggacgtggagcagctgctccactcgggccctgttttcaggactttctcgtccgggtgcgcggaggtcggcctggtcccaggaaggatttgcaggcctgtggctgggtaacccagagtccggtagcgctgaggcgagttgtgccaagacttgagtctgttgtgccaagttcctttccacggatgagactaaatgcacatctgtaccttcgtg

SEQ ID NO: 373731 - DNA, 435 bp, Homo sapiens
gtgtgcagaagtattggacaaatggtcagtggagcaatagtgacgaaataaccctgctcctggctttgcggccaaggagaaaagctcagccgggaagggcacgggcagggaagccgggcaccggggctgggggccggggtccccggggtgacgcggggagggacgggtccggcgcgcccactcccgccctcacgcaccgctgtcgccgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtggtgagtgtgacccgccctgcccctggctcgcggccggccccgggctctcctggcccg

SEQ ID NO: 373732 - DNA, 1899 bp, Homo sapiens
acaggtgtgctggcgtggccctctacctgccccgccgcggcggcctgcggccaggagaagtaggctggcgacatctggcgggccgcgggccgagggaggggaggcggggcggggcggtgtctccctcacgtgaccccaacagcgcccagcgcgtcgcgctgcgccccaacctcggggtcggtcacagtctgcgcctgcgcgggccccggctcgctagccgtcctgcgggacgccggcgctgatgggaaatccagttatcaaaattgactcaagaagagagaacctaacagaacaataacaatggaagaaattgggaacattatcacaaagctatcatcctgccaaactccaggctcagatgtcacaggttaaaaaaagtccttcatgaaaaagaaagatcttaagcagcatgatggattcagaagctcatgaaaagaggccaccaatactaacatcttcaaaacaagatatatcacctcatattacaaatgttggtgagatgaagcattacttgtgtggctgctgtgcagccttcaacaatgtcgcaatcacatttcccattcagaaggtcctctttcgacaacagctgtatggcatcaaaacccgggatgcaatacttcagttgagaagggatggatttcgaaatttgtatcgtggaatccttcccccattgatgcagaagacaactacgcttgcacttatgtttggtctgtatgaggatttatcctgccttctccacaagcatgtcagtgctccagagtttgcaaccagtggcgtggcggcagtgcttgcagggacaacagaagcaattttcactccactggaaagagttcagacattgcttcaagaccacaagcatcatgacaaatttaccaacacttaccaggctttcaaggcactgaaatgtcatggaattggagagtattatcgaggcttggtgcccattcttttccggaatggactcagcaatgtcttgtttttcggccttcgaggtcccattaaggagcatctgcctaccgcaacgactcacagtgctcatctggtcaatgattttatctgtggaggtctattgggtgccatgttgggattcttgttttttccaattaatgttgtaaaaactcgcatacagtctcagattggtggggaatttcagtctttccccaaggttttccaaaaaatctggctggaacgggacagaaaactgataaatcttttcagaggtgcccatctgaattaccatcggtccctcatctcttggggcataatcaatgcaacttatgagttcttgttaaaggttatatgaaaaaaccatcagttaagtgccatttatcaactgaatagaccttctaagaagaatgcagtttggcctcttttttttttttttttaaaggaaatcccaatcttattatggaaagccatcaactgggtgtggggagtaggtcagagggttagtgaaagtccaggggatttctcctccaagtcctaccacacaaaggaaagtctcaagcctctattcaccccttctcaatcctcacaaaatagggggttgttcaatattgtcttcaatgataaaaactttgtggttaaaagtttctccttaggactagtgacaaagttaggcttatacttttttttttttttgaggcagagtcttgctctgttgcccaggctggagtgcagtggcgcgatcttggctcactgcaacctccgcctccagggttcgggcaattctcctgccttagcctcctgtagtcctagctgctcgggaggctgaggcaggagaatctctttcttaattggccaaatataagttggtgtcgtaactccaggccacagtgagttatgggcaaagcttttttccttaagcatcaacaaaataggataaaaggttccaatagg

SEQ ID NO: 373733 - DNA, 1830 bp, Homo sapiens
acaggtgtgctggcgtggccctctacctgccccgccgcggcggcctgcggccaggagaagtaggctggcgacatctggcgggccgcgggccgagggaggggaggcggggcggggcggtgtctccctcacgtgaccccaacagcgcccagcgcgtcgcgctgcgccccaacctcggggtcggtcacagtctgcgcctgcgcgggccccggctcgctagccgtcctgcgggacgccggcgctgatgggaaatccagttatcaaaattgactcaagaagagagaacctaacagaacaataacaatggaagaaattgggaacattatcacaaagctatcatcctgccaaactccaggctcagatgtcacagggtttctattgcctgggctggagtgtagtggcatgatcatggctcactatagccttgacttcctgggctcaagcgatccttccgcctcagcctcctgagtagctgggactacagagacggggtttcgctcttgtgaccaggctggaatgcaatggcgtgatctcggctcaccgcaacctccgacctctgggttcaagtgattctcctgcctccgcctcccaagtagctgggattacaggcatgcgccaccacgcctggctaattttgtatttttagtagagatggggtttctccatgttggtcaggctggtctcaaactcctaacctcaggtgatctgcccacctcggcctcccaaagtgctgggattataggcgtgagccaccgcgccggctgccttaaatctatttatctgacgttcccaactaggaaattttttgtccaaatgagtatatgtgattttaaagtagaaatcgaaggtaaaataggatttatctcagttcctatctcccttcaatctattcttcatattgtcaataatttttttttttttttttgagacgtggtctctgtcgccaggctggagtgcagtggtgaaatcttggctcactgcaccctctgcctcctgtgttcaggcgactctcctgcctcagcctccggagtagctgggattgcaggcatccgccatcacacccggctaaatttcgtattttttcagtagagacagttttgcgccaggctggtctcaaactcctgaccttaagtgatccacctgcctcagcctcccaaagtgctgggattacaggcgtgagccgccgtgcccggccatcagtaattttttaaaatgtcacttcaataaatgcttttcctctgccataaagaccaaacatcttgctgtggcctacaggagacaggatgatccagcccttgcctcccttactctcatctctagctaaaactgcgctgctgtctctgcactccagccactggcacttcctgattacttggggcacgctgtactcatcttgctcccagcctctgcccatgcaggtgccctctgccctcagcactgcctttctctacttcatttatagactgctgtccttcagatctcggttgaagtgtcacttccttggggaagctggcttacactctcaggactcggttaggttcccccgtcaggctcttctatgtcaccatgtttctatttttcacagcacttaacctgttttaattacgttgcaaatagtttttgtttgggtctagagaagcatgtattcactagtacattttatttgtgttctctaattattttttctgcagctaaattagaaatttgtagttttccccctaaaaatgcaatgatgttttctctgattttcttgtcacctttcttccaaaaaatccatgtgttcaaagtgcttgcttgcagtttgccccataataaatggttgtttaatccaaa

SEQ ID NO: 373734 - DNA, 2392 bp, Homo sapiens
cctcttcccctacacaattcaaaggctcttctcttctctcctttcagttgtggcctctaggaccagtgagatccttggaagactcttgcctttccagagtgatgagaatcataaagtcatttaacacctttccccctagtcatcagtatagtcccttcctttcccagagtttcccctggtttttaaaaaaaagaaaattatgatactcaattggcttagtaaaatctcacatttagccagcttagctgaaacatttcagacctatgtttattatacaaggggtttttgtttgtttgtttgtttgtttgtttagggtgagatgaaagaggcaagatttaagaagctgggcaaaaactgagctgatgctggcctttaaagtacctcccaccttgctcaaccccagcaggagaggaataagaagagtttggaagggataatgataccatatgaagcaagagaggacagaaacaggagagtcgagaagcaggatctctagcagtatgcccttgaaggcagagactgcagtcagcgatcggcctaagctctgcacacacggcaatggcaatttgtccaatgagccctgttgaaggtggagtgctgctgcctgtacctcctcatcatcactgttgcttgagcaccgaagaagagtggcccagccttttgggtgcagctgtaaggacgtgatgcagtttccgtggtcactctcaccaagaacttcaggggttacgacttcaagactatttcgtggtgaaactcctgagatataagaaaatgaggatgtgggatttgtattatcaaaaaactaaggcagttcatcaaagctttttatttctggcagccacctcccatgccgtcattccttagtctgccccttatgctaccatatgttaaagagcgtggtactccccaatgtatggtgtgtgagttttggcggggtgaaggtgtggggaaagggtataaatagaacaaaagatccaagttcccacagcagtaattgtcactgacctaaggctaaggcatagaagctgactaggggttcttttatttggatcttacatctcagaaagctctttatttaagtaagaaccaaagttatgtgacatgaaaggactctagaaaggtaaaaggtaacaattctcctctcattggtcctggtgctttctggtccagagaaggaaatacttggaagccatgaggattgccttttaagcaaataaaaagatcaggacttaagcacctgcaataacaacactataaacaaaaaataaaatgttggaggtaagaaaggacacctcacataaaggcatgtcaaaacaagggatgggagacattgccaatcatagactctactatgcctcatcatttccttctacctaactcccaatgaaaatgactgctggagtaaggcactgttaataataggaatatgttatatccttcaggtgcgtgaaaaaccactttcatagacactgtaaggaagcaacttagaaatttaatagcaagagaaatatttcaacacttctctgactgtggaaggagttattttgaaggtattgagctccctctgtcagatcctttgtgaattgcttgtcaagcagatgtgttaccttctttctaaagattcccttcagattactacatcattaacagaaacctgtgaagctctaaattacactgctataacaaaactatactgaaataactatttcacatatgattgaactttaacaattttagagaaaaatatactcttattttaagaattaatttggaaaacctataacaaaaccagacaagaaatgcattctaagtaggtggtttgctaactgtgctcctttggggttcctcaggagatggcaaaagtggggaaccacgtgtgggctgaggtgtagatggagtggggaaggctggagggtcaagagcctccctaatttttcttgaaccagagctactttgattttatttgtgctacatctctaagaatccacagcagatttcatgtcaaaaatagagttctaatgctgaaatgcatttgaaagcctctgctctatacagctattatatctgccaaaggatagtgttaacatactctgacatctgaagatccaggatttccaacatttagagcaacttcacctataagccccaccttctcccatgttttccctctcttttcaccctctcattttcctcttcttcccagcctcctcatatatcatctcttccctcattcttaactctctgtggcatagaactgctgtatatttgtgtttgtgtgtttaccactggtcaataacaagcaagcatgttaactattcttcttaaattaagtttctttttcttgtggatggtgtagtcaatcaataaagatttttctcaatgattattagaa

SEQ ID NO: 373735 - DNA, 1518 bp, Homo sapiens
  misc_feature (10)..(10): n is a, c, g, or t
  misc_feature (44)..(44): n is a, c, g, or t
  misc_feature (169)..(169): n is a, c, g, or t
caaagaaagngagggcaggagagggaaagagaaagagagtgagnaaggaaggaacgtgccaagagctcccatgcaaaatgcccagaagaactggagcagtggcacagatcagcaggagcagaggaatgctgcaaaagatgatgctgcatagagtctaacttggagatgnagacggggtttcgctcttgtgaccaggctggaatgcaatggcgtgatctcggctcaccgcaacctccgacctctgggttcaagtgattctcctgcctccgcctcccaagtagctgggattacaggcatgcgccaccacgcctggctaattttgtatttttagtagagatggggtttctccatgttggtcaggctggtctcaaactcctaacctcaggtgatctgcccacctcggcctcccaaagtgctgggattataggcgtgagccaccgcgccggctgccttaaatctatttatctgacgttcccaactaggaaattttttgtccaaatgagtatatgtgattttaaagtagaaatcgaaggtaaaataggatttatctcagttcctatctcccttcaatctattcttcatattgtcaataatttttttttttttttttgagacgtggtctctgtcgccaggctggagtgcagtggtgaaatcttggctcactgcaccctctgcctcctgtgttcaggcgactctcctgcctcagcctccggagtagctgggattgcaggcatccgccatcacacccggctaaatttcgtattttttcagtagagacagttttgcgccaggctggtctcaaactcctgaccttaagtgatccacctgcctcagcctcccaaagtgctgggattacaggcgtgagccgccgtgcccggccatcagtaattttttaaaatgtcacttcaataaatgcttttcctctgccataaagaccaaacatcttgctgtggcctacaggagacaggatgatccagcccttgcctcccttactctcatctctagctaaaactgcgctgctgtctctgcactccagccactggcacttcctgattacttggggcacgctgtactcatcttgctcccagcctctgcccatgcaggtgccctctgccctcagcactgcctttctctacttcatttatagactgctgtccttcagatctcggttgaagtgtcacttccttggggaagctggcttacactctcaggactcggttaggttcccccgtcaggctcttctatgtcaccatgtttctatttttcacagcacttaacctgttttaattacgttgcaaatagtttttgtttgggtctagagaagcatgtattcactagtacattttatttgtgttctctaattattttttctgcagctaaattagaaatttgtagttttccccctaaaaatgcaatgatgttttctctgattttcttgtcacctttcttccaaaaaatccatgtgttcaaagtgcttgcttgcagtttgccccataataaatggttgtttaatccaaa

SEQ ID NO: 373736 - DNA, 752 bp, Homo sapiens
acaggtgtgctggcgtggccctctacctgccccgccgcggcggcctgcggccaggagaagtaggctggcgacatctggcgggccgcgggccgagggaggggaggcggggcggggcggtgtctccctcacgtgaccccaacagcgcccagcgcgtcgcgctgcgccccaacctcggggtcggtcacagtctgcgcctgcgcgggccccggctcgctagccgtcctgcgggacgccggcgctgatgggaaatccagttatcaaaattgactcaagaagagagaacctaacagaacaataacaatggaagaaattgggaacattatcacaaagctatcatcctgccaaactccaggctcagatgtcacagaaatggggtctcattatgttccccaggctggtctcaaactcccgggctcaagcgatcctcctgcctcggcttcccaaagtgctgggattacaggtgtgagctactgcacccagcctacatggaatctttctaagtatgggacactatgtaactgcacatgtacaacctctttaagccagccctgaatctaaatctctttcaactacagctatggaataccaagacgatagttatctttgtcccttgagttcccagtactaaactaggcatataatagggattcaaatgttcgttgaatgaaaaactgagtcttaacttgcagttttccaagtcaatgagaaatgtttgcttgcttatggtcagaacagatcttaccctgatgaat

SEQ ID NO: 373737 - DNA, 558 bp, Homo sapiens
tttttgaggcaatctcactctgttgcccaggctggagtgcagtggtgtgctctcagcttactgcagtctcaacttcttgggctcaggtgatcctcccacctcagtttcccgagtagctgggactataggtgtatgccgccatgcctggctaattgtgttttcattttttgtagaaatggggtctcattatgttccccaggctggtctcaaactcccgggctcaagcgatcctcctgcctcggcttcccaaagtgctgggattacaggtgtgagctactgcacccagcctacatggaatctttctaagtatgggacactatgtaactgcacatgtacaacctctttaagccagccctgaatctaaatctctttcaactacagctatggaataccaagacgatagttatctttgtcccttgagttcccagtactaaactaggcatataatagggattcaaatgttcgttgaatgaaaaactgagtcttaacttgcagttttccaagtcaatgagaaatgtttgcttgcttatggtcagaacagatcttaccctgatgaat

SEQ ID NO: 373738 - DNA, 397 bp, Homo sapiens
acaggtgtgctggcgtggccctctacctgccccgccgcggcggcctgcggccaggagaagtaggctggcgacatctggcgggccgcgggccgagggaggggaggcggggcggggcggtgtctccctcacgtgaccccaacagcgcccagcgcgtcgcgctgcgccccaacctcggggtcggtcacagtctgcgcctgcgcgggccccggctcgctagccgtcctgcgggacgccggcgctgatgggaaatccagttatcaaaattgactcaagaagagagaacctaacagaacaataacaatggaagaaattgggaacattatcacaaagctatcatcctgccaaactccaggctcagatgtcacaggtgaatgcaattaaacttcaaggaacacat

SEQ ID NO: 373739 - DNA, 1771 bp, Homo sapiens
agagagagggggcgcccccccgcgcgcggtgtgatgaggggccgcgtgtgtggagagaaaaataaaaatggccccttttttttttttgtaaaaaaaaaaaaaaaaaaaaaaaaaaaaaaaaaaaaaaaaaaaaaaaaaaaaaaaaaaaggctatataaattaaaccagaatttttttttttttaaggaaatccagttatcaaaattgactcaagaagagagaacctaacagaacaataacaatggaagaaattgggaacattatcacaaagctatcatcctgccaaactccaggctcagatgtcacagggtttctattgcctgggctggagtgtagtggcatgatcatggctcactatagccttgacttcctgggctcaagcgatccttccgcctcagcctcctgagtagctgggactacagagacggggtttcgctcttgtgaccaggctggaatgcaatggcgtgatctcggctcaccgcaacctccgacctctgggttcaagtgattctcctgcctccgcctcccaagtagctgggattacaggcatgcgccaccacgcctggctaattttgtatttttagtagagatggggtttctccatgttggtcaggctggtctcaaactcctaacctcaggtgatctgcccacctcggcctcccaaagtgctgggattataggcgtgagccaccgcgccggctgccttaaatctatttatctgacgttcccaactaggaaattttttgtccaaatgagtatatgtgattttaaagtagaaatcgaaggtaaaataggatttatctcagttcctatctcccttcaatctattcttcatattgtcaataatttttttttttttttttgagacgtggtctctgtcgccaggctggagtgcagtggtgaaatcttggctcactgcaccctctgcctcctgtgttcaggcgactctcctgcctcagcctccggagtagctgggattgcaggcatccgccatcacacccggctaaatttcgtattttttcagtagagacagttttgcgccaggctggtctcaaactcctgaccttaagtgatccacctgcctcagcctcccaaagtgctgggattacaggcgtgagccgccgtgcccggccatcagtaattttttaaaatgtcacttcaataaatgcttttcctctgccataaagaccaaacatcttgctgtggcctacaggagacaggatgatccagcccttgcctcccttactctcatctctagctaaaactgcgctgctgtctctgcactccagccactggcacttcctgattacttggggcacgctgtactcatcttgctcccagcctctgcccatgcaggtgccctctgccctcagcactgcctttctctacttcatttatagactgctgtccttcagatctcggttgaagtgtcacttccttggggaagctggcttacactctcaggactcggttaggttcccccgtcaggctcttctatgtcaccatgtttctatttttcacagcacttaacctgttttaattacgttgcaaatagtttttgtttgggtctagagaagcatgtattcactagtacattttatttgtgttctctaattattttttctgcagctaaattagaaatttgtagttttccccctaaaaatgcaatgatgttttctctgattttcttgtcacctttcttccaaaaaatccatgtgttcaaagtgcttgcttgcagtttgccccataataaatggttgtttaatccaaa

SEQ ID NO: 373740 - DNA, 2337 bp, Homo sapiens
cctcttcccctacacaattcaaaggctcttctcttctctcctttcagttgtggcctctaggaccagtgagatccttggaagactcttgcctttccagagtgatgagaatcataaagtcatttaacacctttccccctagtcatcagtatagtcccttcctttcccagagtttcccctggtttttaaaaaaaagaaaattatgatactcaattggcttagtaaaatctcacatttagccagcttagctgaaacatttcagacctatgtttattatacaaggggtttttgtttgtttgtttgtttgtttgtttagggtgagatgaaagaggcaagatttaagaagctgggcaaaaactgagctgatgctggcctttaaagtacctcccaccttgctcaaccccagcaggagaggaataagaagagtttggaagggataatgataccatatgaagcaagagaggacagaaacaggagagtcgagaagcaggatctctagcagtatgcccttgaaggcagagactgcagtcagcgatcggcctaagctctgcacacacggcaatggcaatttgtccaatgagccctgttgaaggtggagtgctgctgcctgtacctcctcatcatcactgttgcttgagcaccgaagaagagtggcccagccttttgggtgcagctgtaaggacgtgatgcagtttccgtggtcactctcaccaagaacttcaggggttacgacttcaagactatttcgtggtgaaactcctgagatataagaaaaatttctggcagccacctcccatgccgtcattccttagtctgccccttatgctaccatatgttaaagagcgtggtactccccaatgtatggtgtgtgagttttggcggggtgaaggtgtggggaaagggtataaatagaacaaaagatccaagttcccacagcagtaattgtcactgacctaaggctaaggcatagaagctgactaggggttcttttatttggatcttacatctcagaaagctctttatttaagtaagaaccaaagttatgtgacatgaaaggactctagaaaggtaaaaggtaacaattctcctctcattggtcctggtgctttctggtccagagaaggaaatacttggaagccatgaggattgccttttaagcaaataaaaagatcaggacttaagcacctgcaataacaacactataaacaaaaaataaaatgttggaggtaagaaaggacacctcacataaaggcatgtcaaaacaagggatgggagacattgccaatcatagactctactatgcctcatcatttccttctacctaactcccaatgaaaatgactgctggagtaaggcactgttaataataggaatatgttatatccttcaggtgcgtgaaaaaccactttcatagacactgtaaggaagcaacttagaaatttaatagcaagagaaatatttcaacacttctctgactgtggaaggagttattttgaaggtattgagctccctctgtcagatcctttgtgaattgcttgtcaagcagatgtgttaccttctttctaaagattcccttcagattactacatcattaacagaaacctgtgaagctctaaattacactgctataacaaaactatactgaaataactatttcacatatgattgaactttaacaattttagagaaaaatatactcttattttaagaattaatttggaaaacctataacaaaaccagacaagaaatgcattctaagtaggtggtttgctaactgtgctcctttggggttcctcaggagatggcaaaagtggggaaccacgtgtgggctgaggtgtagatggagtggggaaggctggagggtcaagagcctccctaatttttcttgaaccagagctactttgattttatttgtgctacatctctaagaatccacagcagatttcatgtcaaaaatagagttctaatgctgaaatgcatttgaaagcctctgctctatacagctattatatctgccaaaggatagtgttaacatactctgacatctgaagatccaggatttccaacatttagagcaacttcacctataagccccaccttctcccatgttttccctctcttttcaccctctcattttcctcttcttcccagcctcctcatatatcatctcttccctcattcttaactctctgtggcatagaactgctgtatatttgtgtttgtgtgtttaccactggtcaataacaagcaagcatgttaactattcttcttaaattaagtttctttttcttgtggatggtgtagtcaatcaataaagatttttctcaatgattattagaa

SEQ ID NO: 373741 - DNA, 2446 bp, Homo sapiens
acaggtgtgctggcgtggccctctacctgccccgccgcggcggcctgcggccaggagaagtaggctggcgacatctggcgggccgcgggccgagggaggggaggcggggcggggcggtgtctccctcacgtgaccccaacagcgcccagcgcgtcgcgctgcgccccaacctcggggtcggtcacagtctgcgcctgcgcgggccccggctcgctagccgtcctgcgggacgccggcgctgatgggaaatccagttatcaaaattgactcaagaagagagaacctaacagaacaataacaatggaagaaattgggaacattatcacaaagctatcatcctgccaaactccaggctcagatgtcacagggtgagatgaaagaggcaagatttaagaagctgggcaaaaactgagctgatgctggcctttaaagtacctcccaccttgctcaaccccagcaggagaggaataagaagagtttggaagggataatgataccatatgaagcaagagaggacagaaacaggagagtcgagaagcaggatctctagcagtatgcccttgaaggcagagactgcagtcagcgatcggcctaagctctgcacacacggcaatggcaatttgtccaatgagccctgttgaaggtggagtgctgctgcctgtacctcctcatcatcactgttgcttgagcaccgaagaagagtggcccagccttttgggtgcagctgtaaggacgtgatgcagtttccgtggtcactctcaccaagaacttcaggggttacgacttcaagactatttcgtggtgaaactcctgagatataagaaaatgaggatgtgggatttgtattatcaaaaaactaaggcagttcatcaaagctttttatttctggcagccacctcccatgccgtcattccttagtctgccccttatgctaccatatgttaaagagcgtggtactccccaatgtatggtgtgtgagttttggcggggtgaaggtgtggggaaagggtataaatagaacaaaagatccaagttcccacagcagtaattgtcactgacctaaggctaaggcatagaagctgactaggggttcttttatttggatcttacatctcagaaagctctttatttaagtaagaaccaaagttatgtgacatgaaaggactctagaaaggtaaaaggtaacaattctcctctcattggtcctggtgctttctggtccagagaaggaaatacttggaagccatgaggattgccttttaagcaaataaaaagatcaggacttaagcacctgcaataacaacactataaacaaaaaataaaatgttggaggtaagaaaggacacctcacataaaggcatgtcaaaacaagggatgggagacattgccaatcatagactctactatgcctcatcatttccttctacctaactcccaatgaaaatgactgctggagtaaggcactgttaataataggaatatgttatatccttcaggtgcgtgaaaaaccactttcatagacactgtaaggaagcaacttagaaatttaatagcaagagaaatatttcaacacttctctgactgtggaaggagttattttgaaggtattgagctccctctgtcagatcctttgtgaattgcttgtcaagcagatgtgttaccttctttctaaagattcccttcagattactacatcattaacagaaacctgtgaagctctaaattacactgctataacaaaactatactgaaataactatttcacatatgattgaactttaacaattttagagaaaaatatactcttattttaagaattaatttggaaaacctataacaaaaccagacaagaaatgcattctaagtaggtggtttgctaactgtgctcctttggggttcctcaggagatggcaaaagtggggaaccacgtgtgggctgaggtgtagatggagtggggaaggctggagggtcaagagcctccctaatttttcttgaaccagagctactttgattttatttgtgctacatctctaagaatccacagcagatttcatgtcaaaaatagagttctaatgctgaaatgcatttgaaagcctctgctctatacagctattatatctgccaaaggatagtgttaacatactctgacatctgaagatccaggatttccaacatttagagcaacttcacctataagccccaccttctcccatgttttccctctcttttcaccctctcattttcctcttcttcccagcctcctcatatatcatctcttccctcattcttaactctctgtggcatagaactgctgtatatttgtgtttgtgtgtttaccactggtcaataacaagcaagcatgttaactattcttcttaaattaagtttctttttcttgtggatggtgtagtcaatcaataaagatttttctcaatgattattagaa

SEQ ID NO: 373742 - DNA, 1587 bp, Homo sapiens
tggcctggccgcggttgcgagggcgccgaggcaggcgcgcggcgggcaggcctgggagggggcgggtccgcgcgggcttcggaggagcccgccctgccagaggagagggaggtcacggcgtaaaggtgcagctgccgccaccgccgcttctgcaaggtctcagggacgggctgcagccatgtcctattgccggcaggaaggctttgcccaggatggttccttctggaatgtctattcccctccttccctccctgaagctctttgtcagggacaaaggtaggatccctccccttccgtcttctccactggatgcctgtgtcgtattcatctgtgaccaccaggtactaccacagagctggagctgaggaagggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggggaatggccagcggtccctgtggagaacagtttaagtcagccttttcctgcttccactatagcacggaggagatcaaggggtcagactgtgtagaccagttccgggccatgcaggaatgcatgcagaaatacccagacctctatccccaagaggatgaggatgaggaagaggaaagagagaagaagccagcagaacaagcagaagaaacagctcccattgaggccactgcaaccaaagaagaggagggatcaagttaatgaaggccacaaggcactgggcaccagtccttttggagtggaccttttgcaaaaggccttgtcatcaccttccaagaaagtttccttctgttgtcctgtgcattataatatacaaaataacttattttgatgatcagaggtcttgaggtcttgacatcttgacatatacactgaaaaaaatgggggttgtatgtatgtgtgtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaaggggtactgtactttattcctgatacattttggtttccatgtaggtgttgagctcctggttttctgtgtttggatgatgaagatttggacccttccattcataatccctttctaagtgaagggagaggctggcttggctgttccttgttattccgaaagccctggtttggggcccatgttcacactggctctcagtctagtcaggtgcaatgttcttgagaggtggggacctaattattaccagagtagcagcaagagaggaaacgttgtgaattaagtattcaattaaaaggaaacatgatttctacctga

SEQ ID NO: 373743 - DNA, 1417 bp, Homo sapiens
tggcctggccgcggttgcgagggcgccgaggcaggcgcgcggcgggcaggcctgggagggggcgggtccgcgcgggcttcggaggagcccgccctgccagaggagagggaggtcacggcgtaaaggtgcagctgccgccaccgccgcttctgcaaggtctcagggacgggctgcagccatgtcctattgccggcaggaagggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggggaatggccagcggtccctgtggagaacagtttaagtcagccttttcctgcttccactatagcacggaggagatcaaggggtcagactgtgtagaccagttccgggccatgcaggaatgcatgcagaaatacccagacctctatccccaagaggatgaggatgaggaagaggaaagagagaagaagccagcagaacaagcagaagaaacagctcccattgaggccactgcaaccaaagaagaggagggatcaagttaatgaaggccacaaggcactgggcaccagtccttttggagtggaccttttgcaaaaggccttgtcatcaccttccaagaaagtttccttctgttgtcctgtgcattataatatacaaaataacttattttgatgatcagaggtcttgaggtcttgacatcttgacatatacactgaaaaaaatgggggttgtatgtatgtgtgtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaaggggtactgtactttattcctgatacattttggtttccatgtaggtgttgagctcctggttttctgtgtttggatgatgaagatttggacccttccattcataatccctttctaagtgaagggagaggctggcttggctgttccttgttattccgaaagccctggtttggggcccatgttcacactggctctcagtctagtcaggtgcaatgttcttgagaggtggggacctaattattaccagagtagcagcaagagaggaaacgttgtgaattaagtattcaattaaaaggaaacatgatttctacctga

SEQ ID NO: 373744 - DNA, 621 bp, Homo sapiens
tggcctggccgcggttgcgagggcgccgaggcaggcgcgcggcgggcaggcctgggagggggcgggtccgcgcgggcttcggaggagcccgccctgccagaggagagggaggtcacggcgtaaaggtgcagctgccgccaccgccgcttctgcaaggtctcagggacgggctgcagccatgtcctattgccggcaggaagggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggggaatggccagcggtccctgtggagaacagtttaagtcagccttttcctgccttccattcataatccctttctaagtgaagggagaggctggcttggctgttccttgttattccgaaagccctggtttggggcccatgttcacactggctctcagtctagtcaggtgcaatgttcttgagaggtggggacctaattattaccagagtagcagcaagagaggaaacgttgtgaattaagtattcaattaaaaggaaacatgatttctacctga

SEQ ID NO: 373745 - DNA, 1312 bp, Homo sapiens
tggcctggccgcggttgcgagggcgccgaggcaggcgcgcggcgggcaggcctgggagggggcgggtccgcgcgggcttcggaggagcccgccctgccagaggagagggaggtcacggcgtaaaggtgcagctgccgccaccgccgcttctgcaaggtctcagggacgggctgcagccatgtcctattgccggcaggaagggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggggaatggccagcggtccctgtggagaacagtttaagtcagccttttcctgcttccactatagcacggaggagatcaaggggtcagactgtgtagaccagttccgggccatgcaggaatgcatgcagaaatacccagacctctatccccaagaggatgaggatgaggaagaggaaagagagaagaagccagcagaacaagcagaagaaacagctcccattgaggccactgcaaccaaagaagaggagggatcaagttaatgaaggccacaaggcactgggcaccagtccttttggagtggaccttttgcaaaaggccttgtcatcaccttccaagaaagtttccttctgttgtcctgtgcattataatatacaaaataacttattttgatgatcagaggtcttgaggtcttgacatcttgacatatacactgaaaaaaatgggggttgtatgtatgtgtgtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaaggggtactgtactttattcctgatacattttggtttccattgttattccgaaagccctggtttggggcccatgttcacactggctctcagtctagtcaggtgcaatgttcttgagaggtggggacctaattattaccagagtagcagcaagagaggaaacgttgtgaattaagtattcaattaaaaggaaacatgatttctacctga

SEQ ID NO: 373746 - DNA, 3251 bp, Homo sapiens
  misc_feature (1670)..(1670): n is a, c, g, or t
ggccgttcggagaccagccccagcgtgccaggaccgtttccggggcctggccggggcgttgccgcggggtcggggaccagcacgagtgctgagtcacgccccgcccgggagcgcctcgggtcagtaactcgggaagacgaccaagcgggagcgggagcgggagcgggagccggagcgagagcgcgcgggcgcggccgacagtgcctgatttgagatggggtcccaggtctcggtggaatcgggagctctgcacgtggtgattgtgggtgggggctttggcgggatcgcagcagccagccagctgcaggccctgaacgtccccttcatgctggtggacatgaaggactccttccaccacaatgtggctgctctccgagcctccgtggagacagggttcgccaaaaagacattcatttcttactcggtgactttcaaggacaacttccggcaggggctagtagtggggatagacctgaagaaccagatggtgctgctgcagggtggcgaggccctgcccttctctcatcttatcctggccacgggcagcactgggcccttcccgggcaagtttaatgaggtttccagccagcaggccgctatccaggcctatgaggacatggtgaggcaggtccagcgctcacggttcatcgtggtggtgggaggaggctcggctggagtggagatggcagcagagattaaaacagaatatcctgagaaagaggtcactctcattcactcccaagtggccctggctgacaaggagctcctgccctccgtccggcaggaagtgaaggagatcctcctccggaagggcgtgcagctgctgctgagtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcatttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggtgggcgtacggactgcttggcgcatggcacccgcctggcaagtgctagaactaatgctattcttctggaataagatgccaatgatgtggtggctagaaatgcaacttgtataaaacaaaaatgggagagagagaggtattaaacaaataccccccttagaggatactttctgggtttggaaggtgtgcttgctgtggtactgggtgagcggctcatgtgtgctggctgcatggtgctggggaggccacagccagcccttcctctgcacctgcctcctctgggatgtgcatgtgtgtgtangtgcttgtggtcatgacgcgtgccatttagagctctcagagcagggcagattgctgggctctggtggccagtgtctgtctgtgagggcaggaaggagagctgcacattgagaacaaaggagggacctgaggtggagagaggcccagcaccccaaatctctgccatcacacggtcggggagcccatacattctgcaacaaccagggacttcacaggagccttgttttcaatttgctaacaggtgcataatccctgtgctccttaagcctcatggccttcctacatttccactttatttgtttgtttgtttatttatttttgagacagtctcgccctgtcacccaggctggagtgcagtggcacgatctcagctcactgcaacctacgccttctgggttcacgtgattctcttgccttagcctcccaagtagctgggactacaggcacgtgccaccatgcctggctaatttttgtattttttaaatagagacggggtttcactgtgttggccaggctggtctcgaacacctgacctcaggtgatccattcgtcttggcctctcgaagtgctgggattccaggcgtgagccactgcggccagcacatttccacttttagatcctactccataccacaggtttcatttaagaagaaagagctagataaatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcagagggggtttctgcgggtgacccccagcatatttctaggttacttatgggcagatttgtaagtgacaaaactccagctgatgctgggaatggggagagggcccttgagggactttgtggttttgtgcttctggtttcctggccaaccccagggtcacttgtctggaggcccagctgggcactaatgtctgccaccgactatgttacagtgtataaatgattcctctatttgggagagatcttccaatccagaggagcccctcttggactgcctgggttaaatctgcatagcagaagtggttgatgagttcatctgaagaaattcaggccccacctccccaccctgcccctccctgctcccttttgatggtggcctctgggtactcgggcagagtccttgggacaccagcctctctggggttctcaggccatcccgttggggctgtcgcccaggcctaagtgagtcgtgtgcctctattggaggatggctgttcccctggtggttgcatccaagtatctgtctttctttatggaccacgaagggaagcccaccttcctggaggcaggaccttcggcctaagaaacacaggccctggtgctatctgacctggggtccagcgaggtgggaatcccagtgtgtgagcgacaggccttcttctattgacttacaatattctagaaggacctacgtgtggggacacagttttccaaactgaggaaaatgttgcaataaaagaatatgttgtaagaaaaaaaaaaa

SEQ ID NO: 373747 - DNA, 2107 bp, Homo sapiens
  misc_feature (2107)..(2107): n is a, c, g, or t
ggccgttcggagaccagccccagcgtgccaggaccgtttccggggcctggccggggcgttgccgcggggtcggggaccagcacgagtgctgagtcacgccccgcccgggagcgcctcgggtcagtaactcgggaagacgaccaagcgggagcgggagcgggagcgggagccggagcgagagcgcgcgggcgcggccgacagtgcctgatttgagatggggtcccaggtctcggtggaatcgggagctctgcacgtggtgattgtgggtgggggctttggcgggatcgcagcagccagccagctgcaggccctgaacgtccccttcatgctggtggacatgaaggactccttccaccacaatgtggctgctctccgagcctccgtggagacagggttcgccaaaaagacattcatttcttactcggtgactttcaaggacaacttccggcaggggctagtagtggggatagacctgaagaaccagatggtgctgctgcagggtggcgaggccctgcccttctctcatcttatcctggccacgggcagcactgggcccttcccgggcaagtttaatgaggtttccagccagcaggccgctatccaggcctatgaggacatggtgaggcaggtccagcgctcacggttcatcgtggtggtgggaggaggctcggctggagtggagatggcagcagagattaaaacagaatatcctgagaaagaggtcactctcattcactcccaagtggccctggctgacaaggagctcctgccctccgtccggcaggaagtgaaggagatcctcctccggaagggcgtgcagctgctgctgagtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcatttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggtgggcgtacggactgcttggcgcatggcacccgcctggcaagtgctagaactaatgctattcttctggaataagatgccaatgatgtggtggctagaaatgcaacttgtataaaacaaaaatgggagagagagaggtattaaacaaataccccccttaaaaaaaaaaaaaaaaaaaaaaaaaaaaaaaaaaaaacaaaaaaacacaaaaaaaaaaaaaaaaaaaaaaaaaaaaaaaaaaaaaaaaaaaacaagaaaaaaacaacaacaaaaaaagcggcgggggggggcggggcaacatgaaataactcacccgcacgagcgggagcgcgcccgaaaaccgagcaccccgatcgcagcgctagtcgagacgtggcgcggagagagagcagcagccactgatgtggaggcgcggcccccaaacacaacccagggacgcaccggcggtgcgccacccaaaataacgacccgctcggcggcacgaccggaagcaagacgacccgcgcggccgtgctactaccgaggacacagcgaacccacaatgggagcggggcagcacaactaatggcgccacacccccacaacgaacacaagattacagcgcgcggcggaacccaacaaactcgcaggccagagtcagctgtcgggccacacgaacagccgacgtgggtgcggacccgcagcattgcagcccgcgaggagaactaggaaaatatcacaggggacggaaaaaagaagn

SEQ ID NO: 373748 - DNA, 2647 bp, Homo sapiens
  misc_feature (1066)..(1066): n is a, c, g, or t
tgtttcacatgtcctcttctccaggtccagcgctcacggttcatcgtggtggtgggaggaggctcggctggagtggagatggcagcagagattaaaacagaatatcctgagaaagaggtcactctcattcactcccaagtggccctggctgacaaggagctcctgccctccgtccggcaggaagtgaaggagatcctcctccggaagggcgtgcagctgctgctgagtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcatttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggtgggcgtacggactgcttggcgcatggcacccgcctggcaagtgctagaactaatgctattcttctggaataagatgccaatgatgtggtggctagaaatgcaacttgtataaaacaaaaatgggagagagagaggtattaaacaaataccccccttagaggatactttctgggtttggaaggtgtgcttgctgtggtactgggtgagcggctcatgtgtgctggctgcatggtgctggggaggccacagccagcccttcctctgcacctgcctcctctgggatgtgcatgtgtgtgtangtgcttgtggtcatgacgcgtgccatttagagctctcagagcagggcagattgctgggctctggtggccagtgtctgtctgtgagggcaggaaggagagctgcacattgagaacaaaggagggacctgaggtggagagaggcccagcaccccaaatctctgccatcacacggtcggggagcccatacattctgcaacaaccagggacttcacaggagccttgttttcaatttgctaacaggtgcataatccctgtgctccttaagcctcatggccttcctacatttccactttatttgtttgtttgtttatttatttttgagacagtctcgccctgtcacccaggctggagtgcagtggcacgatctcagctcactgcaacctacgccttctgggttcacgtgattctcttgccttagcctcccaagtagctgggactacaggcacgtgccaccatgcctggctaatttttgtattttttaaatagagacggggtttcactgtgttggccaggctggtctcgaacacctgacctcaggtgatccattcgtcttggcctctcgaagtgctgggattccaggcgtgagccactgcggccagcacatttccacttttagatcctactccataccacaggtttcatttaagaagaaagagctagataaatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcagagggggtttctgcgggtgacccccagcatatttctaggttacttatgggcagatttgtaagtgacaaaactccagctgatgctgggaatggggagagggcccttgagggactttgtggttttgtgcttctggtttcctggccaaccccagggtcacttgtctggaggcccagctgggcactaatgtctgccaccgactatgttacagtgtataaatgattcctctatttgggagagatcttccaatccagaggagcccctcttggactgcctgggttaaatctgcatagcagaagtggttgatgagttcatctgaagaaattcaggccccacctccccaccctgcccctccctgctcccttttgatggtggcctctgggtactcgggcagagtccttgggacaccagcctctctggggttctcaggccatcccgttggggctgtcgcccaggcctaagtgagtcgtgtgcctctattggaggatggctgttcccctggtggttgcatccaagtatctgtctttctttatggaccacgaagggaagcccaccttcctggaggcaggaccttcggcctaagaaacacaggccctggtgctatctgacctggggtccagcgaggtgggaatcccagtgtgtgagcgacaggccttcttctattgacttacaatattctagaaggacctacgtgtggggacacagttttccaaactgaggaaaatgttgcaataaaagaatatgttgtaagaaaaaaaaaaa

SEQ ID NO: 373749 - DNA, 3386 bp, Homo sapiens
  misc_feature (1805)..(1805): n is a, c, g, or t
ccaaggagttaggagctctatgtcagaccctcccatcactcaggacattacaaagatctcaggagctctgtatcaagaaccggcaatgaggaccaaatattagaacaaatgattcttagtaccccaatttacaagggttttaagagctctgcatcaggaactgggggcagagaccaatatatacttttcttcttatttcacaggggtcagaccagtctgaagtagtaaaaaagttcaagtaactcagtaaaatatccacatgtttaggatttgtagacagtaagggtagtagcagccaccctttattaaggacttaatatgtgctgagttacatgctttgtacgtatttttttgctcatcattacaaaattcctatgagtggggctattgtgcccatgttaatgagcctttgggaggtgtccaagtgagtatcagagatgggatttcaacccaggcaatttgataccaaagcccaggctttgaacatgattgcaacatgaggtgcccgggacgcttccctgtgttgtcccagacagcaagtagacatgcctggaagcactaattttaaacaagctttaatgttgacatcagtctgattgactgttggaatgcccatggcttgtataattataagtgcccaaggatgcttgaagataattttccaggtggccctaggtgaggtgtaggttgtgacatgttggcatattggtagtcctctggcctgggtgtggcaggagggtactgaaagagtcctagtctagaacatgtgggcttaagcccagctcaccactaattggtcctggcattggacagattacttctctggagcttcagtttcctcatctgtaacctggaggtcactctcattcactcccaagtggccctggctgacaaggagctcctgccctccgtccggcaggaagtgaaggagatcctcctccggaagggcgtgcagctgctgctgagtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcatttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggtgggcgtacggactgcttggcgcatggcacccgcctggcaagtgctagaactaatgctattcttctggaataagatgccaatgatgtggtggctagaaatgcaacttgtataaaacaaaaatgggagagagagaggtattaaacaaataccccccttagaggatactttctgggtttggaaggtgtgcttgctgtggtactgggtgagcggctcatgtgtgctggctgcatggtgctggggaggccacagccagcccttcctctgcacctgcctcctctgggatgtgcatgtgtgtgtangtgcttgtggtcatgacgcgtgccatttagagctctcagagcagggcagattgctgggctctggtggccagtgtctgtctgtgagggcaggaaggagagctgcacattgagaacaaaggagggacctgaggtggagagaggcccagcaccccaaatctctgccatcacacggtcggggagcccatacattctgcaacaaccagggacttcacaggagccttgttttcaatttgctaacaggtgcataatccctgtgctccttaagcctcatggccttcctacatttccactttatttgtttgtttgtttatttatttttgagacagtctcgccctgtcacccaggctggagtgcagtggcacgatctcagctcactgcaacctacgccttctgggttcacgtgattctcttgccttagcctcccaagtagctgggactacaggcacgtgccaccatgcctggctaatttttgtattttttaaatagagacggggtttcactgtgttggccaggctggtctcgaacacctgacctcaggtgatccattcgtcttggcctctcgaagtgctgggattccaggcgtgagccactgcggccagcacatttccacttttagatcctactccataccacaggtttcatttaagaagaaagagctagataaatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcagagggggtttctgcgggtgacccccagcatatttctaggttacttatgggcagatttgtaagtgacaaaactccagctgatgctgggaatggggagagggcccttgagggactttgtggttttgtgcttctggtttcctggccaaccccagggtcacttgtctggaggcccagctgggcactaatgtctgccaccgactatgttacagtgtataaatgattcctctatttgggagagatcttccaatccagaggagcccctcttggactgcctgggttaaatctgcatagcagaagtggttgatgagttcatctgaagaaattcaggccccacctccccaccctgcccctccctgctcccttttgatggtggcctctgggtactcgggcagagtccttgggacaccagcctctctggggttctcaggccatcccgttggggctgtcgcccaggcctaagtgagtcgtgtgcctctattggaggatggctgttcccctggtggttgcatccaagtatctgtctttctttatggaccacgaagggaagcccaccttcctggaggcaggaccttcggcctaagaaacacaggccctggtgctatctgacctggggtccagcgaggtgggaatcccagtgtgtgagcgacaggccttcttctattgacttacaatattctagaaggacctacgtgtggggacacagttttccaaactgaggaaaatgttgcaataaaagaatatgttgtaagaaaaaaaaaaa

SEQ ID NO: 373750 - DNA, 3197 bp, Homo sapiens
  misc_feature (1616)..(1616): n is a, c, g, or t
ggccgttcggagaccagccccagcgtgccaggaccgtttccggggcctggccggggcgttgccgcggggtcggggaccagcacgagtgctgagtcacgccccgcccgggagcgcctcgggtcagtaactcgggaagacgaccaagcgggagcgggagcgggagcgggagccggagcgagagcgcgcgggcgcggccgacagtgcctgatttgagatggggtcccaggtctcggtggaatcgggagctctgcacgtggtgattgtgggtgggggctttggcgggatcgcagcagccagccagctgcaggccctgaacgtccccttcatgctggtggacatgaaggactccttccaccacaatgtggctgctctccgagcctccgtggagacagggttcgccaaaaagacattcatttcttactcggtgactttcaaggacaacttccggcaggggctagtagtggggatagacctgaagaaccagatggtgctgctgcagggtggcgaggccctgcccttctctcatcttatcctggccacgggcagcactgggcccttcccgggcaagtttaatgaggtttccagccagcaggccgctatccaggcctatgaggacatggtgaggcaggtccagcgctcacggttcatcgtggtggtgggaggaggctcggctggagtggagatggcagcagagattgctgacaaggagctcctgccctccgtccggcaggaagtgaaggagatcctcctccggaagggcgtgcagctgctgctgagtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcatttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggtgggcgtacggactgcttggcgcatggcacccgcctggcaagtgctagaactaatgctattcttctggaataagatgccaatgatgtggtggctagaaatgcaacttgtataaaacaaaaatgggagagagagaggtattaaacaaataccccccttagaggatactttctgggtttggaaggtgtgcttgctgtggtactgggtgagcggctcatgtgtgctggctgcatggtgctggggaggccacagccagcccttcctctgcacctgcctcctctgggatgtgcatgtgtgtgtangtgcttgtggtcatgacgcgtgccatttagagctctcagagcagggcagattgctgggctctggtggccagtgtctgtctgtgagggcaggaaggagagctgcacattgagaacaaaggagggacctgaggtggagagaggcccagcaccccaaatctctgccatcacacggtcggggagcccatacattctgcaacaaccagggacttcacaggagccttgttttcaatttgctaacaggtgcataatccctgtgctccttaagcctcatggccttcctacatttccactttatttgtttgtttgtttatttatttttgagacagtctcgccctgtcacccaggctggagtgcagtggcacgatctcagctcactgcaacctacgccttctgggttcacgtgattctcttgccttagcctcccaagtagctgggactacaggcacgtgccaccatgcctggctaatttttgtattttttaaatagagacggggtttcactgtgttggccaggctggtctcgaacacctgacctcaggtgatccattcgtcttggcctctcgaagtgctgggattccaggcgtgagccactgcggccagcacatttccacttttagatcctactccataccacaggtttcatttaagaagaaagagctagataaatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcagagggggtttctgcgggtgacccccagcatatttctaggttacttatgggcagatttgtaagtgacaaaactccagctgatgctgggaatggggagagggcccttgagggactttgtggttttgtgcttctggtttcctggccaaccccagggtcacttgtctggaggcccagctgggcactaatgtctgccaccgactatgttacagtgtataaatgattcctctatttgggagagatcttccaatccagaggagcccctcttggactgcctgggttaaatctgcatagcagaagtggttgatgagttcatctgaagaaattcaggccccacctccccaccctgcccctccctgctcccttttgatggtggcctctgggtactcgggcagagtccttgggacaccagcctctctggggttctcaggccatcccgttggggctgtcgcccaggcctaagtgagtcgtgtgcctctattggaggatggctgttcccctggtggttgcatccaagtatctgtctttctttatggaccacgaagggaagcccaccttcctggaggcaggaccttcggcctaagaaacacaggccctggtgctatctgacctggggtccagcgaggtgggaatcccagtgtgtgagcgacaggccttcttctattgacttacaatattctagaaggacctacgtgtggggacacagttttccaaactgaggaaaatgttgcaataaaagaatatgttgtaagaaaaaaaaaaa

SEQ ID NO: 373751 - DNA, 1346 bp, Homo sapiens
ggccgttcggagaccagccccagcgtgccaggaccgtttccggggcctggccggggcgttgccgcggggtcggggaccagcacgagtgctgagtcacgccccgcccgggagcgcctcgggtcagtaactcgggaagacgaccaagcgggagcgggagcgggagcgggagccggagcgagagcgcgcgggcgcggccgacagtgcctgatttgagatggggtcccaggtctcggtggaatcgggagctctgcacgtggtgattgtgggtgggggctttggcgggatcgcagcagccagccagctgcaggccctgaacgtccccttcatgctggtggacatgaaggactccttccaccacaatgtggctgctctccgagcctccgtggagacagggttcgccaaaaagacattcatttcttactcggtgactttcaaggacaacttccggcaggggctagtagtggggatagacctgaagaaccagatggtgctgctgcagggtggcgaggccctgcccttctctcatcttatcctggccacgggcagcactgggcccttcccgggcaagtttaatgaggtttccagccagcaggccgctatccaggcctatgaggacatggtgaggcaggtccagcgctcacggttcatcgtggtggtgggaggaggctcggctggagtggagatggcagcagagattaaaacagaatatcctgagaaagaggtcactctcattcactcccaagtggccctggctgacaaggagctcctgccctccgtccggcaggaagtgaaggagatcctcctccggaagggcgtgcagctgctgctgagtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcatttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtaagagaggccccatgtgctttgcagttttaatagagtttggggttaaacatggggaagcctttttgggctatcccatacctggccactagaacaaactctccaagctggtgatggaaacatccccttagagctctttaaaaataggctgggcgcggtggc

SEQ ID NO: 373752 - DNA, 3131 bp, Homo sapiens
  misc_feature (1550)..(1550): n is a, c, g, or t
ggccgttcggagaccagccccagcgtgccaggaccgtttccggggcctggccggggcgttgccgcggggtcggggaccagcacgagtgctgagtcacgccccgcccgggagcgcctcgggtcagtaactcgggaagacgaccaagcgggagcgggagcgggagcgggagccggagcgagagcgcgcgggcgcggccgacagtgcctgatttgagatggggtcccaggtctcggtggaatcgggagctctgcacgtggtgattgtgggtgggggctttggcgggatcgcagcagccagccagctgcaggccctgaacgtccccttcatgctggtggacatgaaggactccttccaccacaatgtggctgctctccgagcctccgtggagacagggttcgccaaaaagacattcatttcttactcggtgactttcaaggacaacttccggcaggggctagtagtggggatagacctgaagaaccagatggtgctgctgcagggtggcgaggtccagcgctcacggttcatcgtggtggtgggaggaggctcggctggagtggagatggcagcagagattaaaacagaatatcctgagaaagaggtcactctcattcactcccaagtggccctggctgacaaggagctcctgccctccgtccggcaggaagtgaaggagatcctcctccggaagggcgtgcagctgctgctgagtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcatttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggtgggcgtacggactgcttggcgcatggcacccgcctggcaagtgctagaactaatgctattcttctggaataagatgccaatgatgtggtggctagaaatgcaacttgtataaaacaaaaatgggagagagagaggtattaaacaaataccccccttagaggatactttctgggtttggaaggtgtgcttgctgtggtactgggtgagcggctcatgtgtgctggctgcatggtgctggggaggccacagccagcccttcctctgcacctgcctcctctgggatgtgcatgtgtgtgtangtgcttgtggtcatgacgcgtgccatttagagctctcagagcagggcagattgctgggctctggtggccagtgtctgtctgtgagggcaggaaggagagctgcacattgagaacaaaggagggacctgaggtggagagaggcccagcaccccaaatctctgccatcacacggtcggggagcccatacattctgcaacaaccagggacttcacaggagccttgttttcaatttgctaacaggtgcataatccctgtgctccttaagcctcatggccttcctacatttccactttatttgtttgtttgtttatttatttttgagacagtctcgccctgtcacccaggctggagtgcagtggcacgatctcagctcactgcaacctacgccttctgggttcacgtgattctcttgccttagcctcccaagtagctgggactacaggcacgtgccaccatgcctggctaatttttgtattttttaaatagagacggggtttcactgtgttggccaggctggtctcgaacacctgacctcaggtgatccattcgtcttggcctctcgaagtgctgggattccaggcgtgagccactgcggccagcacatttccacttttagatcctactccataccacaggtttcatttaagaagaaagagctagataaatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcagagggggtttctgcgggtgacccccagcatatttctaggttacttatgggcagatttgtaagtgacaaaactccagctgatgctgggaatggggagagggcccttgagggactttgtggttttgtgcttctggtttcctggccaaccccagggtcacttgtctggaggcccagctgggcactaatgtctgccaccgactatgttacagtgtataaatgattcctctatttgggagagatcttccaatccagaggagcccctcttggactgcctgggttaaatctgcatagcagaagtggttgatgagttcatctgaagaaattcaggccccacctccccaccctgcccctccctgctcccttttgatggtggcctctgggtactcgggcagagtccttgggacaccagcctctctggggttctcaggccatcccgttggggctgtcgcccaggcctaagtgagtcgtgtgcctctattggaggatggctgttcccctggtggttgcatccaagtatctgtctttctttatggaccacgaagggaagcccaccttcctggaggcaggaccttcggcctaagaaacacaggccctggtgctatctgacctggggtccagcgaggtgggaatcccagtgtgtgagcgacaggccttcttctattgacttacaatattctagaaggacctacgtgtggggacacagttttccaaactgaggaaaatgttgcaataaaagaatatgttgtaagaaaaaaaaaaa

SEQ ID NO: 373753 - DNA, 2467 bp, Homo sapiens
  misc_feature (886)..(886): n is a, c, g, or t
ggccgttcggagaccagccccagcgtgccaggaccgtttccggggcctggccggggcgttgccgcggggtcggggaccagcacgagtgctgagtcacgccccgcccgggagcgcctcgggtcagtaactcgggaagacgaccaagcgggagcgggagcgggagcgggagccggagcgagagcgcgcgggcgcggccgacagtgcctgatttgagatggggtcccaggtctcggtggaatcgggagctctgcacgtggtgattgtgggtgggggctttggcgggatcgcagcagccagccagctgcaggccctgaacgtccccttcatgctggtggacatgaaggactccttccaccacaatgtggctgctctccgagcctccgtggagacagggttcgccaaaaagacattcatttcttactcggtgactttcaaggacaacttccggcaggggctagtagtggggatagacctgaagaaccagatggtgctgctgcagggtggcgaggccctgcccttctctcatcttatcctggccacgggcagcactgggcccttcccgggcaagtttaatgaggtttccagccagcaggccgctatccaggcctatgaggacatggtgaggcaggtccagcgctcacggttcatcgtggtggtgggaggaggctcggctggagtggagatggcagcagagattaaaacagaatatcctgagaaagaggtattaaacaaataccccccttagaggatactttctgggtttggaaggtgtgcttgctgtggtactgggtgagcggctcatgtgtgctggctgcatggtgctggggaggccacagccagcccttcctctgcacctgcctcctctgggatgtgcatgtgtgtgtangtgcttgtggtcatgacgcgtgccatttagagctctcagagcagggcagattgctgggctctggtggccagtgtctgtctgtgagggcaggaaggagagctgcacattgagaacaaaggagggacctgaggtggagagaggcccagcaccccaaatctctgccatcacacggtcggggagcccatacattctgcaacaaccagggacttcacaggagccttgttttcaatttgctaacaggtgcataatccctgtgctccttaagcctcatggccttcctacatttccactttatttgtttgtttgtttatttatttttgagacagtctcgccctgtcacccaggctggagtgcagtggcacgatctcagctcactgcaacctacgccttctgggttcacgtgattctcttgccttagcctcccaagtagctgggactacaggcacgtgccaccatgcctggctaatttttgtattttttaaatagagacggggtttcactgtgttggccaggctggtctcgaacacctgacctcaggtgatccattcgtcttggcctctcgaagtgctgggattccaggcgtgagccactgcggccagcacatttccacttttagatcctactccataccacaggtttcatttaagaagaaagagctagataaatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcagagggggtttctgcgggtgacccccagcatatttctaggttacttatgggcagatttgtaagtgacaaaactccagctgatgctgggaatggggagagggcccttgagggactttgtggttttgtgcttctggtttcctggccaaccccagggtcacttgtctggaggcccagctgggcactaatgtctgccaccgactatgttacagtgtataaatgattcctctatttgggagagatcttccaatccagaggagcccctcttggactgcctgggttaaatctgcatagcagaagtggttgatgagttcatctgaagaaattcaggccccacctccccaccctgcccctccctgctcccttttgatggtggcctctgggtactcgggcagagtccttgggacaccagcctctctggggttctcaggccatcccgttggggctgtcgcccaggcctaagtgagtcgtgtgcctctattggaggatggctgttcccctggtggttgcatccaagtatctgtctttctttatggaccacgaagggaagcccaccttcctggaggcaggaccttcggcctaagaaacacaggccctggtgctatctgacctggggtccagcgaggtgggaatcccagtgtgtgagcgacaggccttcttctattgacttacaatattctagaaggacctacgtgtggggacacagttttccaaactgaggaaaatgttgcaataaaagaatatgttgtaagaaaaaaaaaaa

SEQ ID NO: 373754 - DNA, 6589 bp, Homo sapiens
ctggtctcgaactcgttgcctcaagtgattcgccttccttggtctcccaaagtgctgggtttacaagtgtgagctaccatgcccggccggatgtttttcaatgaaagttttatggctttcacttttttaaaggcttctacttaaagaatctgtcttagtgaagccttcctttattatgccatttaaaaactacagaaccacccaccacccctttctggtgccttatttttgtatacaactcttatcaccaggtaatatagaatgcattttaaactttttgtttattttctgaattccccagctagaatgtgccatgagagcagatacatttctctctcttcttcattgttattttttcagttcctggtaacagctcagattgcatgtttaataaatacttgccttacgaatgaatgaattcatttctgtcttttcccatctccttgtgtagtgcccggaaggcagtggatgaggaagaggaagcagttgaagaacgtcgcaatatgcgaactatctgggtgactggcagaaaaggtttaactgaaagggaagcagcagcccttatagtggaagaagccagaatgattctgcagcaggacttagttgaaatgggagtgcaatggaatccatgtgccctgttacattctagtacatgctcattgactcatagtgagtccgaagtaaaggaacacacatttatatcccaaactaagagttcttataaaaaattaacatcaaagaacaaaagtaacacaatatttagtgattcttatattaagcattcaccaaatatagtgcaagacttaaataaaagtagagagcatacaagttcctttaattgtaatttccagaatgggaatcaagaacatcagacatgttccattttcagagcaagaaaacgggcctctttagatataaataaagagaagccaggagcctctcagaatgaggggaaaacaagtgataagaaagttgttcagactttttcacagaaaacaaaaaaggcacctttgaatttcaattcagaaaagatgagcagaagttttcgatcttggaaacgtagaaagcatctaaagcgatctagggacagcagccccctgaaagactctggagcgtgtagaatccatttacaaggacagactctgtctaatcctagtctttgtgaagacccgtttaccttagatgagaagaaaacggaatttagaaattcagggccatttgctaaaaatgtatctttgagtggtaaggaaaaagataataaaacatcattcccattacaaataaagcaaaattgttcatggaacataacactaactaatgataattttgtggagcatattgtcacaggatctcagagtaaaaatgtgacttgtcaggccactagtgtggttagtgaaaagggcagaggagtagctgttgaggcagaaaaaataaatgaagtgctgatacaaaatggttcaaaaaaccagaatgtttatatgaaacaccatgacatccatccaattaaccagtacctgcgaaagcaatctcatgaacagacaagcactattaccaaacagaaaaatataatagagagacaaatgccctgtgaagcagtcagtagttacataaatagagactcaaatgttactatcaattgtgaaaggataaagcttaatacagaggaaaataaaccaagtcattttcaggcattaggagatgatataagcagaactgtgatacccagtgaagtacttccatcagctggagcatttagcaaatcagaaggccagcatgagaattttctaaatatttctagactacaagaaaaaacaggtacttatacaacaaacaaaactaaaaataatcatgtttctgacttaggtttagtcctctgtgattttgaagatagtttctatctggatactcagtcagagaaaataatacaacagatggcaactgaaaatgccaaactaggagcaaaggacaccaacctggcagcagggataatgcagaagagcttagtccaacagaactcaatgaactcttttcagaaggagtgtcacattccttttcctgctgaacagcaccctctaggagcgactaagatagatcatttggaccttaagactgtaggtactatgaaacaaagcagtgattcacatggggttgatatcctgactccagaaagcccgattttccattctccaatactattggaggaaaatggtctttttttaaaaaagaatgaagtttctgttactgattcacaattaaatagttttcttcaaggttatcaaacacaagaaactgtgaaaccagttatacttctgattcctcaaaagagaactcccactggtgtagaaggagaatgtcttccagttcctgaaacaagtttgaatatgagtgatagtttactatttgatagcttcagtgatgactatctagtaaaagaacaattacctgatatgcaaatgaaagaaccccttccttcagaagtaacatcaaaccattttagtgattctctgtgtctacaagaagacctaattaaaaaatcaaatgtaaatgagaatcaagatacccaccagcagttgacttgttccaatgatgaatctattatattttcagaaatggattctgttcagatggttgaagctttggacaatgtggatatatttcctgtccaagagaagaatcatactgtagtatctcctagagcattagaactaagtgatccagtacttgatgagcaccaccaaggtgatcaagatggaggagatcaagatgaaagggctgaaaaatcaaaattaactgggaccaggcaaaatcattcattcatatggtcaggggcatcatttgatctaagtccaggactgcaaaggattttagataaagtatccagtcctctagaaaatgaaaagctaaaatcaatgactataaacttttccagtttgaatagaaaaaatacagagttaaatgaagaacaagaagttatttcaaacttggagacaaaacaagtgcagggaatttcattttcttctaataatgaagtaaaaagcaagattgagatgctagaaaacaatgccaatcatgatgaaacctcatccctcttacctcgtaaagaaagtaatatagttgatgataatggtctcattcctcctacacccattccaacatctgcttctaagctgacatttccagggattcttgaaacacctgtaaacccttggaaaactaataatgttttacaacctggtgaaagttatttatttggctcaccttcagatattaaaaaccacgatttaagtccagggagtagaaatgggttcaaagacaacagccctattagtgacacaagcttttcacttcagttatcacaggatggattacagttaactccagcctcaagcagttcagaaagtttgtccataattgatgtagcaagtgaccaaaatcttttccaaacattcattaaggagtggcggtgcaaaaagcgattttccatctcactggcttgtgaaaagattagaagtttgacatcttctaaaactgctactattggcagtaggtttaagcaagctagctcacctcaggaaattcctattagagatgatggatttcccattaaaggttgtgatgacaccttggtggttggactggcagtatgctggggtggaagggatgcctattatttttcactgcagaaggaacaaaagcattctgaaattagtgccagtttggttccaccttctttagatccaagcctgactttgaaagacaggatgtggtaccttcaatcttgcttgcgaaaggaatctgataaagaatgttctgttgtcatctatgacttcatccagagctataaaattcttcttctttcttgtggcatctccttggagcaaagttatgaagatcctaaggtggcatgctggttactagatccagattctcaggagccgactcttcatagcatagttaccagttttcttcctcatgagcttccactcctagaagggatggagaccagccaagggattcaaagcctggggctaaatgctggcagtgagcattctgggcgatacagagcatctgtggagtccattctcatcttcaactctatgaatcagctcaactctttgttgcagaaggaaaaccttcaagatgttttccgtaaggtggaaatgccctctcagtactgcttggccttgctagaactaaatggaattggctttagtactgcagaatgtgaaagtcagaaacatataatgcaagccaagctggatgcaattgagacccaggcctatcaactagctggccacagtttttctttcaccagttcagatgacatcgctgaggttttatttttggaattgaagttgcccccaaatagagagatgaaaaaccaaggcagcaagaaaactctgggttctaccagaagagggattgacaatggacgcaagctaaggctgggaagacagttcagcactagtaaggacgttttaaataaattaaaggcattacatcctttaccaggcttgatattagaatggagaagaatcactaatgctattaccaaagtggtctttccccttcagcgggaaaagtgtcttaatccttttcttggaatggaaagaatctatcctgtatcacagtcgcacactgctacaggacgaataacctttacagaaccaaatattcagaatgtgccaagagattttgaaatcaaaatgccaacactagtaggagaaagcccaccttctcaagctgtaggcaaaggcctacttcccatgggcagaggaaaatataagaagggtttcagcgtgaatcctagatgccaggcacagatggaggagagagctgtagacagaggaatgccattttcaattagcatgcgacatgcctttgtgcctttcccaggtggttcaatactggctgctgactactctcagcttgaactgaggatcttggctcatttatcccatgatcgtcgtctcattcaagtgttaaacactggagctgatgttttcaggagcattgcagcagagtggaagatgattgagccagagtctgttggggatgatctgaggcagcaggcaaaacagatttgctatgggatcatttatggaatgggagctaaatctttgggagagcagatgggcattaaagaaaatgatgctgcatgctatattgactccttcaaatccagatacacagggattaatcaattcatgacagagacagtgaagaattgtaaaagagacggatttgttcagaccattttgggaaggcgtagatatttgccaggaatcaaagacaacaacccttatcgtaaagctcacgctgagcgtcaagctatcaacacaatagtccaaggatcagcagctgatattgtcaaaatagccacagttaacattcagaagcaattagagaccttccactcaaccttcaaatcccatggtcatcgagagggtatgctccaaagtgaccgaacaggattgtcacgaaagagaaaactgcaagggatgttctgcccaatcagaggaggcttcttcatccttcaactccatgatgaactcctatatgaagtggtagaagaagatgttgttcaggtagctcagattgtcaagaatgaaatggaaagtgctgtaaaactgtctgtgaaattgaaagtgaaagtgaaaataggcgccagctggggagagctaaaggactttgatgtgtaactgtgctgttgatgaagtcctcccagggaagcctgtgcagatgcagtcacctggaaagaacagagattaccctttcacctacctcagcaaaacaaactttcaagtcttgatagacttagcctagtaattttatagtgagagtttcaaactatatatcagtgtctatagcatcaaaaacttctgggggcgtgggggaagtagaataccaagtataatagttacattcactttcaaagagcatctatgaatttgccttttgtaacttactgtggctttaaacatattcagaacagatgcttgaaatatgcacttagcactttggttccacatctgtctgggtaaaccatgaagaaaatgaagctgctgcctcaatcgacccagacagcagccataggcagataaagatttggtttcaccctggtggtggtaggcatcgtgtgtgactttttttcctctaatatcaattttacagtacggaaatagtattttaaaatagtattggctaataaattatgaattctataaagtagtaagacttggtatggttggagtgtaggaatgaatattcatgaaatgtttcttattgcttttccttccctaattcatacaatgaatgtatttggaatacttacatattataaaataaactatacctcttcaagaggtatcctgttctgtaagatcagatgtttttattgcaggtcaatataatactgccagagacagaaaatacccccttatcagtcccttagtgcctctttctgtttgtggcatggtgagaaaacccatgctgaaaagattgtactttgtgatcccaatcagagggatggagctaatctttttgctgttgaaataaaatgaatttatgagaaactttaaaaaaaaaa

SEQ ID NO: 373755 - DNA, 2294 bp, Homo sapiens
taattaatctgatagtgtctaattagagtatggatagactacctgacatataaattttgattgccatcatttattaaatatggtaattccaaattatccacagaaacattatttcaatccatgttgaactgtagagattgttttctgaaataacttaaaatattttctgaatgataatccttgcaagtttcattcttgactaaagagacattaatttcttgcaggttttatttttggaattgaagttgcccccaaatagagagatgaaaaaccaaggcagcaagaaaactctgggttctaccagaagagggattgacaatggacgcaagctaaggctgggaagacagttcagcactagtaaggacgttttaaataaattaaaggcattacatcctttaccaggcttgatattagaatggagaagaatcactaatgctattaccaaagtggtctttccccttcagcgggaaaagtgtcttaatccttttcttggaatggaaagaatctatcctgtatcacagtcgcacactgctacaggacgaataacctttacagaaccaaatattcagaatgtgccaagagattttgaaatcaaaatgccaacactagtaggagaaagcccaccttctcaagctgtaggcaaaggcctacttcccatgggcagaggaaaatataagaagggtttcagcgtgaatcctagatgccaggcacagatggaggagagagctgtagacagaggaatgccattttcaattagcatgcgacatgcctttgtgcctttcccagatttgctatgggatcatttatggaatgggagctaaatctttgggagagcagatgggcattaaagaaaatgatgctgcatgctatattgactccttcaaatccagatacacagggattaatcaattcatgacagagacagtgaagaattgtaaaagagacggatttgttcagaccattttgggaaggcgtagatatttgccaggaatcaaagacaacaacccttatcgtaaagctcacgctgagcgtcaagctatcaacacaatagtccaaggatcagcagctgatattgtcaaaatagccacagttaacattcagaagcaattagagaccttccactcaaccttcaaatcccatggtcatcgagagggtatgctccaaagtgaccgaacaggattgtcacgaaagagaaaactgcaagggatgttctgcccaatcagaggaggcttcttcatccttcaactccatgatgaactcctatatgaagtggtagaagaagatgttgttcaggtagctcagattgtcaagaatgaaatggaaagtgctgtaaaactgtctgtgaaattgaaagtgaaagtgaaaataggcgccagctggggagagctaaaggactttgatgtgtaactgtgctgttgatgaagtcctcccagggaagcctgtgcagatgcagtcacctggaaagaacagagattaccctttcacctacctcagcaaaacaaactttcaagtcttgatagacttagcctagtaattttatagtgagagtttcaaactatatatcagtgtctatagcatcaaaaacttctgggggcgtgggggaagtagaataccaagtataatagttacattcactttcaaagagcatctatgaatttgccttttgtaacttactgtggctttaaacatattcagaacagatgcttgaaatatgcacttagcactttggttccacatctgtctgggtaaaccatgaagaaaatgaagctgctgcctcaatcgacccagacagcagccataggcagataaagatttggtttcaccctggtggtggtaggcatcgtgtgtgactttttttcctctaatatcaattttacagtacggaaatagtattttaaaatagtattggctaataaattatgaattctataaagtagtaagacttggtatggttggagtgtaggaatgaatattcatgaaatgtttcttattgcttttccttccctaattcatacaatgaatgtatttggaatacttacatattataaaataaactatacctcttcaagaggtatcctgttctgtaagatcagatgtttttattgcaggtcaatataatactgccagagacagaaaatacccccttatcagtcccttagtgcctctttctgtttgtggcatggtgagaaaacccatgctgaaaagattgtactttgtgatcccaatcagagggatggagctaatctttttgctgttgaaataaaatgaatttatgagaaactttaaaaaaaaaa

SEQ ID NO: 373756 - DNA, 306 bp, Homo sapiens
caacaaatattctatgaatgttctagggatgattacagtattttccaaccgtctgggctggcacaacatggaactactactttcccaatttcagaagcgtcttacgtttggcatccagagggagctgtgtgacctggttcgggtatccttactaaatgctcagagagccagggttctctatgcttctggctttcatactgtggcagaccttgctagagcaaatattgtggaggtggaggtgattctgaaaaatgctgtgcctttcaaaaggtaagaaaatacctttacctacatgggcttatgaaa

SEQ ID NO: 373757 - DNA, 9062 bp, Homo sapiens
  misc_feature (291)..(291): n is a, c, g, or t
  misc_feature (298)..(298): n is a, c, g, or t
  misc_feature (1512)..(1512): n is a, c, g, or t
  misc_feature (1842)..(1842): n is a, c, g, or t
atgaatggtcaccgttttacgttcagaactcgttcgcttctacctttacaaaagggacaacacagatgcattactaagctcttggctcataacgatccctggggtatattcagagccccttcctcgcggcgttcatatagtgtctcaggggtctgtcagccagcaatccccaattcctcattacatattcctcacaatgcatgctggctaaaatggaaattgtgttcagaaatagccctgccctaccatcatatactaggagaaaggaggaaattatgctctattagaaantttgaanactggcgggaagatgtccgcagctgttgccaggccagggttctcccgagagggaggacgctgggactgtggcttgccctgatcggccgagaagagtttgccatgaatcttctgcgtcggagtgggaaacggcggcgttcagaatcaggctcagattcgttctcgggaagcggcggtgacagcagtgccagcccccagttcctctccgggtccgtgctgagcccgccgcccggccttggtcgctgcctgaaggccgcagctgcaggagaatgcaagcctacagttcctgactacgaaatagacaagctactattggcaaactggggacttcctaaagcagttctggaaaaataccacagttttggtgtaaaaaagatgtttgaatggcaggcagagtgccttttgcttggacaagtcctggaaggaaagaatttagtttattcagctcctacaagtgctgggaagactcttgtggcagaattacttattttgaagcgggttttggaaatgcggaagaaagctttgtttattcttccctttgtttctgtggctaaagagaagaaatactacctccagagtctgtttcaggaagtaggaataaaagtagacggttatatgggcagcacctctccatcaaggcatttctcttcattggatattgcagtctgcacaattgagagagccaatggtctgatcaatcgcctcatagaggaaaataagatggatctgttaggaatggtggttgtggatgaattacatatgctgggagactctcaccgagggtatctgctggaacttttgctgaccaagatttgctatattactcggaaatcagcatcttgtcaggcagatctagccagttctctgtctaatgctgtgcaaatcgttggcatgagtgctacccttcctaatttggagcttgtggcttcctggttgaatgctgaactctaccataccgactttcgccctgtaccgcttttggagtcagtaaaagttggaaattccatatatgactcttcaatgaaacttgtgagggaatttgagcccatgctacaagtgaagggagatgaggaccatgttgttagtttatgttatgagacgatttgtgataaccattcagtattacttttttgtccatcaaagaaatggtgtgagaagctggcagatatcattgctcgagagttttataatctacatcatcaagctgagggtganggattggtgaaaccctctgaatgcccaccagtaattctggaacaaaaagaactcctggaagtgatggatcagttaagacgtttgccttcaggactggactctgtattacagaaaactgtaccatggggagtagcatttcatcatgcaggtcttacttttgaggagagggatatcattgaaggagcctttcgtcaaggtctcattcgggtcttggcggcaacttctactctttcttctggggtgaatttacctgcacgtcgtgtgattattcgaacccctatttttggtggtcgacctctagatattcttacttataagcagatggttggncgtgctggcaggaaaggagtggacacagtagggagtatcttaatttgtaagaactctgagaaatcaaaaggcatagctctccttcagggttctctaaagcctgttcgcagctgtctgcaaagacgagaaggagaagaagtaactggcagcatgatacgagctattctggagataatagttggtggagtggcaagtacatcacaagatatgcatacttatgctgcctgcacatttttggctgcaagtatgaaagaagggaagcaaggaattcagagaaatcaagagtctgttcagcttggagtgattgaggcctgtgtgatgtggctactagaaaatgaattcatccagagtacagaagccagtgatggaacagaaggaaaggtgtatcatccaacacatcttggttcggccactctttcttcttcactttctccagctgatactttagatatttttgctgacctgcaaagagcaatgaagggctttgttttagagaatgatcttcatattctctatctggttacacctatgtttgaggattggactactattgattggtatcgatttttctgtttatgggagaagttgccaacttcaatgaaaagggtggcagagctagtgggagttgaagaggggttcttggcccgttgtgtgaaaggaaaagtagtagccagaactgagagacagcatcgacaaatggccatccataaaaggtttttcaccagtcttgtgctattagatttaatcagtgaagttcccttaagggaaataaatcagaaatatggatgcaatcgtgggcagattcaatctttgcaacagtcagctgctgtttatgcagggatgattacagtattttccaaccgtctgggctggcacaacatggaactactactttcccaatttcagaagcgtcttacgtttggcatccagagggagctgtgtgacctggttcgggtatccttactaaatgctcagagagccagggttctctatgcttctggctttcatactgtggcagaccttgctagagcaaatattgtggaggtggaggtgattctgaaaaatgctgtgcctttcaaaagtgcccggaaggcagtggatgaggaagaggaagcagttgaagaacgtcgcaatatgcgaactatctgggtgactggcagaaaaggtttaactgaaagggaagcagcagcccttatagtggaagaagccagaatgattctgcagcaggacttagttgaaatgggagtgcaatggaatccatgtgccctgttacattctagtacatgctcattgactcatagtgagtccgaagtaaaggaacacacatttatatcccaaactaagagttcttataaaaaattaacatcaaagaacaaaagtaacacaatatttagtgattcttatattaagcattcaccaaatatagtgcaagacttaaataaaagtagagagcatacaagttcctttaattgtaatttccagaatgggaatcaagaacatcagacatgttccattttcagagcaagaaaacgggcctctttagatataaataaagagaagccaggagcctctcagaatgaggggaaaacaagtgataagaaagttgttcagactttttcacagaaaacaaaaaaggcacctttgaatttcaattcagaaaagatgagcagaagttttcgatcttggaaacgtagaaagcatctaaagcgatctagggacagcagccccctgaaagactctggagcgtgtagaatccatttacaaggacagactctgtctaatcctagtctttgtgaagacccgtttaccttagatgagaagaaaacggaatttagaaattcagggccatttgctaaaaatgtatctttgagtggtaaggaaaaagataataaaacatcattcccattacaaataaagcaaaattgttcatggaacataacactaactaatgataattttgtggagcatattgtcacaggatctcagagtaaaaatgtgacttgtcaggccactagtgtggttagtgaaaagggcagaggagtagctgttgaggcagaaaaaataaatgaagtgctgatacaaaatggttcaaaaaaccagaatgtttatatgaaacaccatgacatccatccaattaaccagtacctgcgaaagcaatctcatgaacagacaagcactattaccaaacagaaaaatataatagagagacaaatgccctgtgaagcagtcagtagttacataaatagagactcaaatgttactatcaattgtgaaaggataaagcttaatacagaggaaaataaaccaagtcattttcaggcattaggagatgatataagcagaactgtgatacccagtgaagtacttccatcagctggagcatttagcaaatcagaaggccagcatgagaattttctaaatatttctagactacaagaaaaaacaggtacttatacaacaaacaaaactaaaaataatcatgtttctgacttaggtttagtcctctgtgattttgaagatagtttctatctggatactcagtcagagaaaataatacaacagatggcaactgaaaatgccaaactaggagcaaaggacaccaacctggcagcagggataatgcagaagagcttagtccaacagaactcaatgaactcttttcagaaggagtgtcacattccttttcctgctgaacagcaccctctaggagcgactaagatagatcatttggaccttaagactgtaggtactatgaaacaaagcagtgattcacatggggttgatatcctgactccagaaagcccgattttccattctccaatactattggaggaaaatggtctttttttaaaaaagaatgaagtttctgttactgattcacaattaaatagttttcttcaaggttatcaaacacaagaaactgtgaaaccagttatacttctgattcctcaaaagagaactcccactggtgtagaaggagaatgtcttccagttcctgaaacaagtttgaatatgagtgatagtttactatttgatagcttcagtgatgactatctagtaaaagaacaattacctgatatgcaaatgaaagaaccccttccttcagaagtaacatcaaaccattttagtgattctctgtgtctacaagaagacctaattaaaaaatcaaatgtaaatgagaatcaagatacccaccagcagttgacttgttccaatgatgaatctattatattttcagaaatggattctgttcagatggttgaagctttggacaatgtggatatatttcctgtccaagagaagaatcatactgtagtatctcctagagcattagaactaagtgatccagtacttgatgagcaccaccaaggtgatcaagatggaggagatcaagatgaaagggctgaaaaatcaaaattaactgggaccaggcaaaatcattcattcatatggtcaggggcatcatttgatctaagtccaggactgcaaaggattttagataaagtatccagtcctctagaaaatgaaaagctaaaatcaatgactataaacttttccagtttgaatagaaaaaatacagagttaaatgaagaacaagaagttatttcaaacttggagacaaaacaagtgcagggaatttcattttcttctaataatgaagtaaaaagcaagattgagatgctagaaaacaatgccaatcatgatgaaacctcatccctcttacctcgtaaagaaagtaatatagttgatgataatggtctcattcctcctacacccattccaacatctgcttctaagctgacatttccagggattcttgaaacacctgtaaacccttggaaaactaataatgttttacaacctggtgaaagttatttatttggctcaccttcagatattaaaaaccacgatttaagtccagggagtagaaatgggttcaaagacaacagccctattagtgacacaagcttttcacttcagttatcacaggatggattacagttaactccagcctcaagcagttcagaaagtttgtccataattgatgtagcaagtgaccaaaatcttttccaaacattcattaaggagtggcggtgcaaaaagcgattttccatctcactggcttgtgaaaagattagaagtttgacatcttctaaaactgctactattggcagtaggtttaagcaagctagctcacctcaggaaattcctattagagatgatggatttcccattaaaggttgtgatgacaccttggtggttggactggcagtatgctggggtggaagggatgcctattatttttcactgcagaaggaacaaaagcattctgaaattagtgccagtttggttccaccttctttagatccaagcctgactttgaaagacaggatgtggtaccttcaatcttgcttgcgaaaggaatctgataaagaatgttctgttgtcatctatgacttcatccagagctataaaattcttcttctttcttgtggcatctccttggagcaaagttatgaagatcctaaggtggcatgctggttactagatccagattctcaggagccgactcttcatagcatagttaccagttttcttcctcatgagcttccactcctagaagggatggagaccagccaagggattcaaagcctggggctaaatgctggcagtgagcattctgggcgatacagagcatctgtggagtccattctcatcttcaactctatgaatcagctcaactctttgttgcagaaggaaaaccttcaagatgttttccgtaaggtggaaatgccctctcagtactgcttggccttgctagaactaaatggaattggctttagtactgcagaatgtgaaagtcagaaacatataatgcaagccaagctggatgcaattgagacccaggcctatcaactagctggccacagtttttctttcaccagttcagatgacatcgctgaggttttatttttggaattgaagttgcccccaaatagagagatgaaaaaccaaggcagcaagaaaactctgggttctaccagaagagggattgacaatggacgcaagctaaggctgggaagacagttcagcactagtaaggacgttttaaataaattaaaggcattacatcctttaccaggcttgatattagaatggagaagaatcactaatgctattaccaaagtggtctttccccttcagcgggaaaagtgtcttaatccttttcttggaatggaaagaatctatcctgtatcacagtcgcacactgctacaggacgaataacctttacagaaccaaatattcagaatgtgccaagagattttgaaatcaaaatgccaacactagtaggagaaagcccaccttctcaagctgtaggcaaaggcctacttcccatgggcagaggaaaatataagaagggtttcagcgtgaatcctagatgccaggcacagatggaggagagagctgtagacagaggaatgccattttcaattagcatgcgacatgcctttgtgcctttcccaggtggttcaatactggctgctgactactctcagcttgaactgaggatcttggctcatttatcccatgatcgtcgtctcattcaagtgttaaacactggagctgatgttttcaggagcattgcagcagagtggaagatgattgagccagagtctgttggggatgatctgaggcagcaggcaaaacagatttgctatgggatcatttatggaatgggagctaaatctttgggagagcagatgggcattaaagaaaatgatgctgcatgctatattgactccttcaaatccagatacacagggattaatcaattcatgacagagacagtgaagaattgtaaaagagacggatttgttcagaccattttgggaaggcgtagatatttgccaggaatcaaagacaacaacccttatcgtaaagctcacgctgagcgtcaagctatcaacacaatagtccaaggatcagcagctgatattgtcaaaatagccacagttaacattcagaagcaattagagaccttccactcaaccttcaaatcccatggtcatcgagagggtatgctccaaagtgaccgaacaggattgtcacgaaagagaaaactgcaagggatgttctgcccaatcagaggaggcttcttcatccttcaactccatgatgaactcctatatgaagtggtagaagaagatgttgttcaggtagctcagattgtcaagaatgaaatggaaagtgctgtaaaactgtctgtgaaattgaaagtgaaagtgaaaataggcgccagctggggagagctaaaggactttgatgtgtaactgtgctgttgatgaagtcctcccagggaagcctgtgcagatgcagtcacctggaaagaacagagattaccctttcacctacctcagcaaaacaaactttcaagtcttgatagacttagcctagtaattttatagtgagagtttcaaactatatatcagtgtctatagcatcaaaaacttctgggggcgtgggggaagtagaataccaagtataatagttacattcactttcaaagagcatctatgaatttgccttttgtaacttactgtggctttaaacatattcagaacagatgcttgaaatatgcacttagcactttggttccacatctgtctgggtaaaccatgaagaaaatgaagctgctgcctcaatcgacccagacagcagccataggcagataaagatttggtttcaccctggtggtggtaggcatcgtgtgtgactttttttcctctaatatcaattttacagtacggaaatagtattttaaaatagtattggctaataaattatgaattctataaagtagtaagacttggtatggttggagtgtaggaatgaatattcatgaaatgtttcttattgcttttccttccctaattcatacaatgaatgtatttggaatacttacatattataaaataaactatacctcttcaagaggtatcctgttctgtaagatcagatgtttttattgcaggtcaatataatactgccagagacagaaaatacccccttatcagtcccttagtgcctctttctgtttgtggcatggtgagaaaacccatgctgaaaagattgtactttgtgatcccaatcagagggatggagctaatctttttgctgttgaaataaaatgaatttatgagaaactttaaaaaaaaaa

SEQ ID NO: 373758 - DNA, 2013 bp, Homo sapiens
  misc_feature (26)..(26): n is a, c, g, or t
catgagctgttctagaggatccctgntgtctgacaatttgttgcagaaggaaaaccttcaagatgttttccgtaaggtggaaatgccctctcagtactgcttggccttgctagaactaaatggaattggctttagtactgcagaatgtgaaagtcagaaacatataatgcaagccaagctggatgcaattgagacccaggcctatcaactagctggccacagtttttctttcaccagttcagatgacatcgctgaggacgaataacctttacagaaccaaatattcagaatgtgccaagagattttgaaatcaaaatgccaacactagtaggagaaagcccaccttctcaagctgtaggcaaaggcctacttcccatgggcagaggaaaatataagaagggtttcagcgtgaatcctagatgccaggcacagatggaggagagagctgtagacagaggaatgccattttcaattagcatgcgacatgcctttgtgcctttcccagatttgctatgggatcatttatggaatgggagctaaatctttgggagagcagatgggcattaaagaaaatgatgctgcatgctatattgactccttcaaatccagatacacagggattaatcaattcatgacagagacagtgaagaattgtaaaagagacggatttgttcagaccattttgggaaggcgtagatatttgccaggaatcaaagacaacaacccttatcgtaaagctcacgctgagcgtcaagctatcaacacaatagtccaaggatcagcagctgatattgtcaaaatagccacagttaacattcagaagcaattagagaccttccactcaaccttcaaatcccatggtcatcgagagggtatgctccaaagtgaccgaacaggattgtcacgaaagagaaaactgcaagggatgttctgcccaatcagaggaggcttcttcatccttcaactccatgatgaactcctatatgaagtggtagaagaagatgttgttcaggtagctcagattgtcaagaatgaaatggaaagtgctgtaaaactgtctgtgaaattgaaagtgaaagtgaaaataggcgccagctggggagagctaaaggactttgatgtgtaactgtgctgttgatgaagtcctcccagggaagcctgtgcagatgcagtcacctggaaagaacagagattaccctttcacctacctcagcaaaacaaactttcaagtcttgatagacttagcctagtaattttatagtgagagtttcaaactatatatcagtgtctatagcatcaaaaacttctgggggcgtgggggaagtagaataccaagtataatagttacattcactttcaaagagcatctatgaatttgccttttgtaacttactgtggctttaaacatattcagaacagatgcttgaaatatgcacttagcactttggttccacatctgtctgggtaaaccatgaagaaaatgaagctgctgcctcaatcgacccagacagcagccataggcagataaagatttggtttcaccctggtggtggtaggcatcgtgtgtgactttttttcctctaatatcaattttacagtacggaaatagtattttaaaatagtattggctaataaattatgaattctataaagtagtaagacttggtatggttggagtgtaggaatgaatattcatgaaatgtttcttattgcttttccttccctaattcatacaatgaatgtatttggaatacttacatattataaaataaactatacctcttcaagaggtatcctgttctgtaagatcagatgtttttattgcaggtcaatataatactgccagagacagaaaatacccccttatcagtcccttagtgcctctttctgtttgtggcatggtgagaaaacccatgctgaaaagattgtactttgtgatcccaatcagagggatggagctaatctttttgctgttgaaataaaatgaatttatgagaaactttaaaaaaaaaa

SEQ ID NO: 373759 - DNA, 7692 bp, Homo sapiens
  misc_feature (291)..(291): n is a, c, g, or t
  misc_feature (298)..(298): n is a, c, g, or t
  misc_feature (1512)..(1512): n is a, c, g, or t
  misc_feature (1842)..(1842): n is a, c, g, or t
atgaatggtcaccgttttacgttcagaactcgttcgcttctacctttacaaaagggacaacacagatgcattactaagctcttggctcataacgatccctggggtatattcagagccccttcctcgcggcgttcatatagtgtctcaggggtctgtcagccagcaatccccaattcctcattacatattcctcacaatgcatgctggctaaaatggaaattgtgttcagaaatagccctgccctaccatcatatactaggagaaaggaggaaattatgctctattagaaantttgaanactggcgggaagatgtccgcagctgttgccaggccagggttctcccgagagggaggacgctgggactgtggcttgccctgatcggccgagaagagtttgccatgaatcttctgcgtcggagtgggaaacggcggcgttcagaatcaggctcagattcgttctcgggaagcggcggtgacagcagtgccagcccccagttcctctccgggtccgtgctgagcccgccgcccggccttggtcgctgcctgaaggccgcagctgcaggagaatgcaagcctacagttcctgactacgaaatagacaagctactattggcaaactggggacttcctaaagcagttctggaaaaataccacagttttggtgtaaaaaagatgtttgaatggcaggcagagtgccttttgcttggacaagtcctggaaggaaagaatttagtttattcagctcctacaagtgctgggaagactcttgtggcagaattacttattttgaagcgggttttggaaatgcggaagaaagctttgtttattcttccctttgtttctgtggctaaagagaagaaatactacctccagagtctgtttcaggaagtaggaataaaagtagacggttatatgggcagcacctctccatcaaggcatttctcttcattggatattgcagtctgcacaattgagagagccaatggtctgatcaatcgcctcatagaggaaaataagatggatctgttaggaatggtggttgtggatgaattacatatgctgggagactctcaccgagggtatctgctggaacttttgctgaccaagatttgctatattactcggaaatcagcatcttgtcaggcagatctagccagttctctgtctaatgctgtgcaaatcgttggcatgagtgctacccttcctaatttggagcttgtggcttcctggttgaatgctgaactctaccataccgactttcgccctgtaccgcttttggagtcagtaaaagttggaaattccatatatgactcttcaatgaaacttgtgagggaatttgagcccatgctacaagtgaagggagatgaggaccatgttgttagtttatgttatgagacgatttgtgataaccattcagtattacttttttgtccatcaaagaaatggtgtgagaagctggcagatatcattgctcgagagttttataatctacatcatcaagctgagggtganggattggtgaaaccctctgaatgcccaccagtaattctggaacaaaaagaactcctggaagtgatggatcagttaagacgtttgccttcaggactggactctgtattacagaaaactgtaccatggggagtagcatttcatcatgcaggtcttacttttgaggagagggatatcattgaaggagcctttcgtcaaggtctcattcgggtcttggcggcaacttctactctttcttctggggtgaatttacctgcacgtcgtgtgattattcgaacccctatttttggtggtcgacctctagatattcttacttataagcagatggttggncgtgctggcaggaaaggagtggacacagtagggagtatcttaatttgtaagaactctgagaaatcaaaaggcatagctctccttcagggttctctaaagcctgttcgcagctgtctgcaaagacgagaaggagaagaagtaactggcagcatgatacgagctattctggagataatagttggtggagtggcaagtacatcacaagatatgcatacttatgctgcctgcacatttttggctgcaagtatgaaagaagggaagcaaggaattcagagaaatcaagagtctgttcagcttggagtgattgaggcctgtgtgatgtggctactagaaaatgaattcatccagagtacagaagccagtgatggaacagaaggaaaggtgtatcatccaacacatcttggttcggccactctttcttcttcactttctccagctgatactttagatatttttgctgacctgcaaagagcaatgaagggctttgttttagagaatgatcttcatattctctatctggttacacctatgtttgaggattggactactattgattggtatcgatttttctgtttatgggagaagttgccaacttcaatgaaaagggtggcagagctagtgggagttgaagaggggttcttggcccgttgtgtgaaaggaaaagtagtagccagaactgagagacagcatcgacaaatggccatccataaaaggtttttcaccagtcttgtgctattagatttaatcagtgaagttcccttaagggaaataaatcagaaatatggatgcaatcgtgggcagattcaatctttgcaacagtcagctgctgtttatgcagggatgattacagtattttccaaccgtctgggctggcacaacatggaactactactttcccaatttcagaagcgtcttacgtttggcatccagagggagctgtgtgacctggttcgggtatccttactaaatgctcagagagccagggttctctatgcttctggctttcatactgtggcagaccttgctagagcaaatattgtggaggtggaggtgattctgaaaaatgctgtgcctttcaaaagtgcccggaaggcagtggatgaggaagaggaagcagttgaagaacgtcgcaatatgcgaactatctgggtgactggcagaaaaggtttaactgaaagggaagcagcagcccttatagtggaagaagccagaatgattctgcagcaggacttagttgaaatgggagtgcaatggaatccatgtgccctgttacattctagtacatgctcattgactcatagtgagtccgaagtaaaggaacacacatttatatcccaaactaagagttcttataaaaaattaacatcaaagaacaaaagtaacacaatatttagtgattcttatattaagcattcaccaaatatagtgcaagacttaaataaaagtagagagcatacaagttcctttaattgtaatttccagaatgggaatcaagaacatcagacatgttccattttcagagcaagaaaacgggcctctttagatataaataaagagaagccaggagcctctcagaatgaggggaaaacaagtgataagaaagttgttcagactttttcacagaaaacaaaaaaggcacctttgaatttcaattcagaaaagatgagcagaagttttcgatcttggaaacgtagaaagcatctaaagcgatctagggacagcagccccctgaaagactctggagcgtgtagaatccatttacaaggacagactctgtctaatcctagtctttgtgaagacccgtttaccttagatgagaagaaaacggaatttagaaattcagggccatttgctaaaaatgtatctttgagtggtaaggaaaaagataataaaacatcattcccattacaaataaagcaaaattgttcatggaacataacactaactaatgataattttgtggagcatattgtcacaggatctcagagtaaaaatgtgacttgtcaggccactagtgtggttagtgaaaagggcagaggagtagctgttgaggcagaaaaaataaatgaagtgctgatacaaaatggttcaaaaaaccagaatgtttatatgaaacaccatgacatccatccaattaaccagtacctgcgaaagcaatctcatgaacagacaagcactattaccaaacagaaaaatataatagagagacaaatgccctgtgaagcagtcagtagttacataaatagagactcaaatgttactatcaattgtgaaaggataaagcttaatacagaggaaaataaaccaagtcattttcaggcattaggagatgatataagcagaactgtgatacccagtgaagtacttccatcagctggagcatttagcaaatcagaaggccagcatgagaattttctaaatatttctagactacaagaaaaaacaggtacttatacaacaaacaaaactaaaaataatcatgtttctgacttaggtttagtcctctgtgattttgaagatagtttctatctggatactcagtcagagaaaataatacaacagatggcaactgaaaatgccaaactaggagcaaaggacaccaacctggcagcagggataatgcagaagagcttagtccaacagaactcaatgaactcttttcagaaggagtgtcacattccttttcctgctgaacagcaccctctaggagcgactaagatagatcatttggaccttaagactgtaggtactatgaaacaaagcagtgattcacatggggttgatatcctgactccagaaagcccgattttccattctccaatactattggaggaaaatggtctttttttaaaaaagaatgaagtttctgttactgattcacaattaaatagttttcttcaaggttatcaaacacaagaaactgtgaaaccagttatacttctgattcctcaaaagagaactcccactggtgtagaaggagaatgtcttccagttcctgaaacaagtttgaatatgagtgatagtttactatttgatagcttcagtgatgactatctagtaaaagaacaattacctgatatgcaaatgaaagaaccccttccttcagaagtaacatcaaaccattttagtgattctctgtgtctacaagaagacctaattaaaaaatcaaatgtaaatgagaatcaagatacccaccagcagttgacttgttccaatgatgaatctattatattttcagaaatggattctgttcagatggttgaagctttggacaatgtggatatatttcctgtccaagagaagaatcatactgtagtatctcctagagcattagaactaagtgatccagtacttgatgagcaccaccaaggtgatcaagatggaggagatcaagatgaaagggctgaaaaatcaaaattaactgggaccaggcaaaatcattcattcatatggtcaggggcatcatttgatctaagtccaggactgcaaaggattttagataaagtatccagtcctctagaaaatgaaaagctaaaatcaatgactataaacttttccagtttgaatagaaaaaatacagagttaaatgaagaacaagaagttatttcaaacttggagacaaaacaagtgcagggaatttcattttcttctaataatgaagtaaaaagcaagattgagatgctagaaaacaatgccaatcatgatgaaacctcatccctcttacctcgtaaagaaagtaatatagttgatgataatggtctcattcctcctacacccattccaacatctgcttctaagctgacatttccagggattcttgaaacacctgtaaacccttggaaaactaataatgttttacaacctggtgaaagttatttatttggctcaccttcagatattaaaaaccacgatttaagtccagggagtagaaatgggttcaaagacaacagccctattagtgacacaagcttttcacttcagttatcacaggatggattacagttaactccagcctcaagcagttcagaaagtttgtccataattgatgtagcaagtgaccaaaatcttttccaaacattcattaaggagtggcggtgcaaaaagcgattttccatctcactggcttgtgaaaagattagaagtttgacatcttctaaaactgctactattggcagtaggtttaagcaagctagctcacctcaggaaattcctattagagatgatggatttcccattaaaggttgtgatgacaccttggtggttggactggcagtatgctggggtggaagggatgcctattatttttcactgcagaaggaacaaaagcattctgaaattagtgccagtttggttccaccttctttagatccaagcctgactttgaaagacaggatgtggtaccttcaatcttgcttgcgaaaggaatctgataaagaatgttctgttgtcatctatgacttcatccagagctataaaattcttcttctttcttgtggcatctccttggagcaaagttatgaagatcctaaggtggcatgctggttactagatccagattctcaggagccgactcttcatagcatagttaccagttttcttcctcatgagcttccactcctagaagggatggagaccagccaagggattcaaagcctggggctaaatgctggcagtgagcattctgggcgatacagagcatctgtggagtccattctcatcttcaactctatgaatcagctcaactctttgttgcagaaggaaaaccttcaagatgttttccgtaaggtggaaatgccctctcagtactgcttggccttgctagaactaaatggaattggctttagtactgcagaatgtgaaagtcagaaacatataatgcaagccaagctggatgcaattgagacccaggcctatcaactagctggccacagtttttctttcaccagttcagatgacatcgctgaggttttatttttggaattgaagttgcccccaaatagagagatgaaaaaccaaggcagcaagaaaactctgggttctaccagaagagggattgacaatggacgcaagctaaggctgggaagacagttcagcactagtaaggacgttttaaataaattaaaggcattacatcctttaccaggcttgatattagaatggagaagaatcactaatgctattaccaaagtggtctttccccttcagcgggaaaagtgtcttaatccttttcttggaatggaaagaatctatcctgtatcacagtcgcacactgctacaggacgaataacctttacagaaccaaatattcagaatgtgccaagagattttgaaatcaaaatgccaacactagtaggagaaagcccaccttctcaagctgtaggcaaaggcctacttcccatgggcagaggaaaatataagaagggtttcagcgtgaatcctagatgccaggcacagatggaggagagagctgtagacagaggaatgccattttcaattagcatgcgacatgcctttgtgcctttcccaggtggttcaatactggctgctgactactctcagcttgaactgaggatcttggctcatttatcccatgatcgtcgtctcattcaagtgttaaacactggagctgatgttttcaggagcattgcagcagagtggaagatgattgagccagagtctgttggggatgatctgaggcagcaggcaaaacagatttgctatgggatcatttatggaatgggagctaaatctttgggagagcagatgggcattaaagaaaatgatgctgcatgctatattgactccttcaaatccagatacacaggtaatttatcttctagatagtattct

SEQ ID NO: 373760 - DNA, 285 bp, Homo sapiens
gtttatctgaatttggtatgtgtatttttaaagtcatcactttagagtaatatatcacagtgtgttaagatggctaataaaaagaaaattatacttggatttacttttccatgtaaaactgaaggactgagatgtaagataccaatttggtgaaataaggatttagctcaacattgtatgtttttgagcttggccattatttaagacaacatttgagagttttgattacttgacatcctaatgtgctaaggtatcaacaactaaaaaataaagtatcatgaaaat

SEQ ID NO: 373761 - DNA, 2528 bp, Homo sapiens
acgccaaggttgcgggtcatggagtcccgaaccctcctcctgctgttctcgggagccgtggccctgatccagacctgggcagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatcacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctggggatcaggatctattacctgtgcctggagaggaggggactcctcttctcacccgctggtctctggacacatactgtccaattcccctgtggcagctgtaatgtgtagttcaatgggcactcatttgtccccttttaagggtaccctcctttagaatccaggaccttctaccctgcagagtgtggtttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggccagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgaaccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttacacagatgctaattcgtaggggcacttggaatcacatggttgttttgtgtcccatggtcaagcattctatcttatcagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcgccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagtatatccaggttctccagatctcttaagactgtactatagaggcctggggaattataatagccctgaggcaaactatgaattaaagtgttgtggatcccacatgaaaaaaaaaa

SEQ ID NO: 373762 - DNA, 2416 bp, Homo sapiens
acgccaaggttgcgggtcatggagtcccgaaccctcctcctgctgttctcgggagccgtggccctgatccagacctgggcagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatcacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctggggatcaggatctattacctgtgcctggagaggaggggactcctcttctcacccgctggtctctggacacatactgtccaattcccctgtggcagctgtaatgtgtagttcaatgggcactcatttgtccccttttaagggtaccctcctttagaatccaggaccttctaccctgcagagtgtggtttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggccagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgaaccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttacacagatgctaattcgtaggggcacttggaatcacatggttgttttgtgtcccatggtcaagcattctatcttatcagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcgccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagta

SEQ ID NO: 373763 - DNA, 1065 bp, Homo sapiens
acgccaaggttgcgggtcatggagtcccgaaccctcctcctgctgttctcgggagccgtggccctgatccagacctgggcagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatcacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctggggatcaggatctattacctgtgcctggagaggaggggactcctcttctcacccgctggtctctggacacatactgtccaattcccctgtggcagctgtaatgtgtagttcaatgggcactcatttgtccccttttaagggtaccctcctttagaatccaggaccttctaccctgcagagtgtggtttgggagagaagtgcaaaatcccacgacaggaccctgactgtcccacagaagaagtgacaagaatttatttatgacatgacaataacacatgtattcatggtgttaattcgatttgtttcatagagacagcgtcttgctatgttgcccaggctggtcttcaactcctggcctcaagcaatccccctgacttggccttccaaagtgctagcattacaggtgtgagccattgtgcccagcccttaacttgaaaatc

SEQ ID NO: 373764 - DNA, 2507 bp, Homo sapiens
acgccaaggttgcgggtcatggagtcccgaaccctcctcctgctgttctcgggagccgtggccctgatccagacctgggcaggtgagtgcggggtcgggagggaaaaggcctctgcgggaaggagcgaggggcccgcccggaggagtaaatctgcacatatatttaattacagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatcacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctggggatcaggatctattacctgtgcctggagaggaggggactcctcttctcacccgctggtctctggacacatactgtccaattcccctgtggcagctgtaatgtgtagttcaatgggcactcatttgtccccttttaagggtaccctcctttagaatccaggaccttctaccctgcagagtgtggtttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggccagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgaaccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttacacagatgctaattcgtaggggcacttggaatcacatggttgttttgtgtcccatggtcaagcattctatcttatcagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcgccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagta

SEQ ID NO: 373765 - DNA, 355 bp, Homo sapiens
ttaagtggactctctgctgagaatatcacaagcctacagtcaagctgttgactgggttttattctcatctgaaactcagagtcatcttccaagcttgaacttgtgggcagaattctgtgttttgcagctataggactgatgacttcaactcctagaggacacccctctccataggaagttcaagatgtagttttttgcttcttcaaggccagcaggagatcatttctaacttcagggaagtcctggaccctctttgaacgggctaaactgattaggtcagcctcacccagggtaatctccctttacattgactcaaagtcaacttattaagaacattaattatttctgtaaaatt

SEQ ID NO: 373766 - DNA, 491 bp, Homo sapiens
gcttcaggatgggccccactctgaggcctttgggacagaccaggccatgtgtgagaacagagagggctttggggaggaggcacgtaaacacagccacgtcagtaggattcctgtggccctttccaagctaacacactgttcttcctcccactcatgagccagcctgggcagcaagcacccacctcctactgttgttggagggggcagggagtgctgggcacagctgggactattattacctggatagttatgtcatcatcagtgaccttggactagtgttttgttttgtttttaactaagcattaaatattttattacaattgataactttaaaattaaatattgaatgactaactgattacatttaaataattaaatagactgtcaacagagactattataggagaatgtgtcctgaaacatctctattcacatgcacgtgtgtatcccgtataagcagtatccaatatatgtatatatgactattttcc

SEQ ID NO: 373767 - DNA, 345 bp, Homo sapiens
ctcttatacacacactgccatgtaattgatatagatatcaacttgataaattaaaaaaatacagctgggcacggtggttcacacctgtaatcccagcactttgggaggctgaggtgggcggatcacgaggtcaagagattgagaccatcctggccaacatggtgaaaccccgtctctactaaaaatacaaaaattagctgggcatggtggcgcgcacctgtagtcccagctacttgggaggctgaggtggaagaatcgcttgaatccgggagctggaggttgcagtgagccgagattatgccactgcactccagcctggcgacagagccagactccatctcaccg

SEQ ID NO: 373768 - DNA, 1954 bp, Homo sapiens
  misc_feature (1949)..(1949): n is a, c, g, or t
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcgcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcaaggtggaaactgagtcagacagaggcgaggtgacttgtctgaggtcacagctagtgagtggtgaagccaagattggaacccaggcaatccagcttggaaggacaaaggatggggtctctgaaacatctccagcctcagccctgctcctggccttctctctcatccagacatggctgcagcctctgggctgggactggcctccctacctccccttcaatccagtgcttccctgctgccagaaggagctttccagaaagcacatgtcaccacagccctctcttgctggaacccaacctctacaggagaccaagctgcctcctacagaccacaggacctccaagactcaccatcgccacctcttgttattcctgccctgactttcctatcaccaccatcaaaggagagtcccccagagattacatctcatggcccgggcttgcggagtgctgggctcccagacaaatgcaatcaaaggagacatgtctcctgggaagagcctcccacaacctcaaagccccgaaagccctccgtgtttatgttcttgcttgatccccacaaccgtccagcaaagccagcacagcagagatgattctatttccccaggagtggtgcccagagaagttaagcagtttgcctgagatgacacagccgtgttggagccgtgcttgcttgggatgaactaagtggcgcgcatttgattttactgctgatttcacagctccttcagctaccccaagctgccatcaatgtcccatcaatttcactttgtctgctcctctctgcaatgagctttctcagctctcagcctgtgttcagtaaagagacgttgctggtcttgtgtcacgtctcctcctgcctgaataatgctcgtgtgcagcatgaaggagaggtctctcagaactcaagggcctgaagctcccagaagcttccagatccagaggcaacaggtgtcttccggtcccagggagggcaagtttcctgaacctcgaaggcaggcagacagtggaggcctcccttccttctcacagcatcctccagctccaaggcaggcttcccccaacccccagggcccaggaactgtcatcagagcagaaatcaagcccagtcccaggcctcaccccacagggcatctgccccattgatatttgcttggtaataaatactggagacngaggg

SEQ ID NO: 373769 - DNA, 398 bp, Homo sapiens
tgttttcgtttcacagatgaggaccccggagctcagagaggaaaagtaacttgctctaatcagtggctagcagatcagcgccccctcccccggccaaggctgggagctctttcaggatagggggcctgtcccaccacccatgtaccttgctcacagtagacctcactaagtgcggattcctcaggcaaatgtgcaggtgttttgctgagtgctctgagcttttctttttgccccgggctccctaggaagtgggaatgatggctccatttcacagatgaggaaaccgagactcagagcacaaggccacacagcaggaagaggtaaggcaggactgagggaggcagcacgtctggcctgggagaggggttaaccagccaggaggagctcgtagaagggct

SEQ ID NO: 373770 - DNA, 345 bp, Homo sapiens
ctactactactaaattcgcggccgcgtcgacctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgaccaggagcagtcgacgcggccgcgaat

SEQ ID NO: 373771 - DNA, 6072 bp, Homo sapiens
agcggagtctttgcccccgcagggccgcggacggaggtggtggcggagttcccgctgcccacaagtctggcccgaccttctggggtgggggcctgggggcaggggccctgggccggagaacccggggccgcctaacggctcggagctcaccgccgggggacaccggcgctgaggcctgggtctcagaaagtgggaagtgggaatgatggctccatttcacagatgaggaaaccgagactcagagcacaaggccacacagcaggaagagagaaatgaaaacttacggtcccacagaaacgcgggtttgtagcagctctattcataatcatcaacaactggaaacaacccacatggccttcagtgaccgaatggataaacaagctgttacacgtaccccagggaatactgctctccaataaaaaggagcggactcttgatacacacagtgacttggaggaatctcaaaggcattctgctcaatgacaggagccagcctcaaaagatttggctgactgaggacgcgacaggtactcagcttctttctgcatctcagtcgcccagcacaggggctggcacgcacccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373772 - DNA, 5878 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggactttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373773 - DNA, 5846 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373774 - DNA, 6066 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatctgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373775 - DNA, 6028 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373776 - DNA, 5961 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtcaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373777 - DNA, 2778 bp, Homo sapiens
tagaggcagtgaatcgagctcggtacctgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373778 - DNA, 4442 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373779 - DNA, 3423 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacaaattagcttcaaaaaaacttggggggcactgttttattaattttgactggtctcctttgatatagttaagagggcattctttatttaatat

SEQ ID NO: 373780 - DNA, 3347 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtagcaatgtaccgaccatgcctatgaactccgccaagtaggtgtccagtctctagacatgcaaacctcacctattcctaactaacaggcaagaaaatcccacctactcgatggcaggcatccgccatgagtgcggcagaacccaactttgcacccaccatgcaacttagcaatgcgcatggcagagagaattaatcccagaggccaggtaggtacacagaaaacaaagtcaggcgctggaggctggatgacgactcagccgcgaaccggggcaaaacagggaggatggaggagcggaattggtgacaataaaatgacagacccttcacagagcaatgggaccaggtggaggggcccctgcccagggagatccttctccccgaagcgcacccgggtggaagctctaaacgaattgcccttgcggcctcatgattgacaaacgagatttatacccgaagacgccccatcgattaatggagggaatggcccagctaaaatggaatcgtcgaatatatcttctcaggaatgcgacaagctagagggcgacgaaaaacgaaaagctctgaaaaattcgaagtcgtggactgctgacgcgtaaggagacccgccggcgacccgaggccttccgagcctcacctaaagcggaatcccgagaaggccgaagatcggacggggccgaaatttgaaagccaacaccaactgcaggcgttccctgggtccccagtggcgtatagcccgcgaagcgccgtcgaagagagcggacccccaggaggcgccgacgaaaccgtcccaacgggggtcccacacgagtatatagtgcacctcggatagggcggcgccctcaaaccagacagcgctaaagccgcccatgggagacccga

SEQ ID NO: 373781 - DNA, 1662 bp, Homo sapiens
agcggagtctttgcccccgcagggccgcggacggaggtggtggcggagttcccgctgcccacaagtctggcccgaccttctggggtgggggcctgggggcaggggccctgggccggagaacccggggccgcctaacggctcggagctcaccgccgggggacaccggcgctgaggcctgggtctcagaaagtgggaagtgggaatgatggctccatttcacagatgaggaaaccgagactcagagcacaaggccacacagcaggaagagagaaatgaaaacttacggtcccacagaaacgcgggtttgtagcagctctattcataatcatcaacaactggaaacaacccacatggccttcagtgaccgaatggataaacaagctgttacacgtaccccagggaatactgctctccaataaaaaggagcggactcttgatacacacagtgacttggaggaatctcaaaggcattctgctcaatgacaggagccagcctcaaaagatttggctgactgaggacgcgacaggtactcagcttctttctgcatctcagtcgcccagcacaggggctggcacgcacccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagtacacccagtgggttggagcttgcagtcgccaccatctgcaaggagcgctcataagtgtgtgcactgcctctgggcgttgtggtacagagatggaggaagcccaggcccagcctctaggaattcacagcctagaggagaggcagatcaattcagtgtctgcaaaacccctcgcaccccccctattttatccccagagccacttctgtttgaaccacttctgtttcctctctaacctgagatgcacacgttaggatttggaattacaatttttaaagctcagcataggtaatatgcctctatttctacgaaatattctatggctccctattgcctacagaataaaggctgagctcctctggagttagggttgctggaataaaataaatgcacacccagtggcatgtctggtaccagcagacactgggtgggtggggcctgctagaggccaagtcagtggtcttctgctaaaaagtatggttcatccccctcccccaggggacttccttaaagcgagtccttaccgggctcaggttttctgtctgggagtccgtgtaaaagaaaacccaatcataggaccaggtaacccattaactcatgaactccatcaacacagcatcctcctgacagaaccggacatgggcaggggccaggggctcagtcctccccctttataaagagatcgagtctcaatgcggggaagtgactcgcccagtgtcacatagggccttggaatgacaggagcaggctgaagcagcagcattgagtctggaggggacaggatcggggacagacagctttgatttgagaaatgtgaataggggcggaggcgtggagtccaggaccccagctgtcttgcagcagtggccagaggaagcaggagcagtcctcctgccctgctgggagggagtcagctgtcccaccc

SEQ ID NO: 373782 - DNA, 345 bp, Homo sapiens
aacaactggaaacaacccacatggccttcagtgaccgaatggataaacaagctgttacacgtaccccagggaatactgctctccaataaaaaggagcggactcttgatacacacagtgacttggaggaatctcaaaggcattctgctcaatgacaggagccagcctcaaaaggttctacgctttatcattccacttacatggcatatttgaaaacacaaaagccatagtgtcagagaatagatcagtggttgccagggtggaggtgtgaggggagggagtggccagcgccagggagtttttggggtgatggaactgctcgttgtcttgatctggagctggtggct

SEQ ID NO: 373783 - DNA, 790 bp, Homo sapiens
cgctgggacacatcccctcctctgaccctgtggccttgctggactctctcccacagtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacaccca

SEQ ID NO: 373784 - DNA, 6101 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373785 - DNA, 5906 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcgcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373786 - DNA, 6217 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggcccggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373787 - DNA, 5905 bp, Homo sapiens
cagtggcatggctgctctgggaaacagtttgatgctttctctgaaagtccaacagggatgtaccacacagctcagcaattccacccctggcatttacatagagaaatgaaaacttacggtcccacagaaacgcgggtttgtagcagctctattcataatcatcaacaactggaaacaacccacatggccttcagtgaccgaatggataaacaagctgttacacgtaccccagggaatactgctctccaataaaaaggagcggactcttgatacacacagtgacttggaggaatctcaaaggcattctgctcaatgacaggagccagcctcaaaagatttggctgactgaggacgcgacaggtactcagcttctttctgcatctcagtcgcccagcacaggggctggcacgcacccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373788 - DNA, 5582 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagcttacaggg

SEQ ID NO: 373789 - DNA, 4658 bp, Homo sapiens
aaaataaaaaaaaaaagagaaaacggaaaaaaaaaaaaaaaaaaaaaaaaaaaacctcattggacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373790 - DNA, 5806 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373791 - DNA, 4221 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcaaaaaaaaaaaaaaaaaaaaaaaaaaaaaaaaaaaaaaaaaacaaaaaaaaaaaaaaaaaaaaaaaaaaaaaacgaagagaaaaaaaggaacgaaaacgacaacacgacagaacgcgtagagaacacagaagaaaaagcgtggagggcggccagggcgacgccggaaaggaggagaggaaggggggaagagaggcgggagagggggaggggaggagcgcgagagggcgggggcagagggacgggacacgcgagagggagggcggcgcgcgcggcgcggcgagaaggagcaggacgaggcagaggaagtagcgggagggaggacaagacaggggaacgaacaaggaaagcatggggaaggcgaaaaggcacgcacgagcgggcgcagagaagaagagacggggcagaaggaagacaacgcagggaaggcggacgacccgacacaccaaacggccgaagg

SEQ ID NO: 373792 - DNA, 6081 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccacactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373793 - DNA, 5747 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373794 - DNA, 5941 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373795 - DNA, 5867 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373796 - DNA, 4134 bp, Homo sapiens
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccatctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggt

SEQ ID NO: 373797 - DNA, 1943 bp, Homo sapiens
agcggagtctttgcccccgcagggccgcggacggaggtggtggcggagttcccgctgcccacaagtctggcccgaccttctggggtgggggcctgggggcaggggccctgggccggagaacccggggccgcctaacggctcggagctcaccgccgggggacaccggcgctgaggcctgggtctcagaaagtgggaagtgggaatgatggctccatttcacagatgaggaaaccgagactcagagcacaaggccacacagcaggaagagagaaatgaaaacttacggtcccacagaaacgcgggtttgtagcagctctattcataatcatcaacaactggaaacaacccacatggccttcagtgaccgaatggataaacaagctgttacacgtaccccagggaatactgctctccaataaaaaggagcggactcttgatacacacagtgacttggaggaatctcaaaggcattctgctcaatgacaggagccagcctcaaaagatttggctgactgaggacgcgacaggtactcagcttctttctgcatctcagtcgcccagcacaggggctggcacgcacccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcaatgctgcgcccacaccccggcctctgatgaagctctctgctggggatgtgctgccatcttgtggccattggtggaatacacccagtgggttggagcttgcagtcgccaccatctgcaaggagcgctcataagtgtgtgcactgcctctgggcgttgtggtacagagatggaggaagcccaggcccagcctctaggaattcacagcctagaggagaggcagatcaattcagtgtctgcaaaacccctcgcaccccccctattttatccccagagccacttctgtttgaaccacttctgtttcctctctaacctgagatgcacacgttaggatttggaattacaatttttaaagctcagcataggtaatatgcctctatttctacgaaatattctatggctccctattgcctacagaataaaggctgagctcctctggagttagggttgctggaataaaataaatgcacacccagtggcatgtctggtaccagcagacactgggtgggtggggcctgctagaggccaagtcagtggtcttctgctaaaaagtatggttcatccccctcccccaggggacttccttaaagcgagtccttaccgggctcaggttttctgtctgggagtccgtgtaaaagaaaacccaatcataggaccaggtaacccattaactcatgaactccatcaacacagcatcctcctgacagaaccggacatgggcaggggccaggggctcagtcctccccctttataaagagatcgagtctcaatgcggggaagtgactcgcccagtgtcacatagggccttggaatgacaggagcaggctgaagcagcagcattgagtctggaggggacaggatcggggacagacagctttgatttgagaaatgtgaataggggcggaggcgtggagtccaggaccccagctgtcttgcagcagtggccagaggaagcaggagcagtcctcctgccctgctgggagggagtcagctgtcccaccc

SEQ ID NO: 373798 - DNA, 1837 bp, Homo sapiens
agcggagcgtgcgggtggcctggatcccgcgcagtggcccggcgatgtcgctcgtgctgctaagcctggccgcgctgtgcaggagcgccgtaccccgagagccgaccgttcaatgtggctctgaaactgggccatctccagagtggatgctacaacatgatctaatccccggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacagctgtgtgaggtgcaattacacagaggccttccagactcagaccagaccctctggtggtaaatggacattttcctatatcggcttccctgtagagctgaacacagtctatttcattggggcccataatattcctaatgcaaatatgaatgaagatggcccttccatgtctgtgaatttcacctcaccaggctgcctagaccacataatgaaatataaaaaaaagtgtgtcaaggccggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcagctgactccatattttcctacttgtggcagcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaacaataaagcatcttcagcc

SEQ ID NO: 373799 - DNA, 2044 bp, Homo sapiens
agcggagcgtgcgggtggcctggatcccgcgcagtggcccggcgatgtcgctcgtgctgctaagcctggccgcgctgtgcaggagcgccgtaccccgagagccgaccgttcaatgtggctctgaaactgggccatctccagagtggatgctacaacatgatctaatccccggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacagctgtgtgaggtgcaattacacagaggccttccagactcagaccagaccctctggtggtaaatggacattttcctatatcggcttccctgtagagctgaacacagtctatttcattggggcccataatattcctaatgcaaatatgaatgaagatggcccttccatgtctgtgaatttcacctcaccaggctgcctagaccacataatgaaatataaaaaaaagtgtgtcaaggccggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcagctgactccatattttcctacttgtggcagcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaacaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaaccttctattacatgcaaaaaatcattgtttttaagataacaaaagtagggaataaacaagctgaacccactttt

SEQ ID NO: 373800 - DNA, 786 bp, Homo sapiens
caaaggtgaataagctttgttttttccagacaaaagcaagccgggaggctggctgcctctcctcctgctgtctctgctggtggccacatgggtgctggtggcagggatctatctaatgtggaggcacgggtaagggttataattctttaaagacatcctagtaaggaaataacattttgaatttttttttaaagaagattcctctggaggcaatcacatgttggcgtttcccagagttagatagcatttatgtaataccttcaagtgctcctacagagactgatacgagcatgactggattacacatgccaggtgaaagcagggtcaggacttccagatcttctgactgtcccgtttttatttttaccattgagccttctaccagtactgaaatgggcaaaagatggctgataacaaattacactttacctgtgatggttactctatgctagttcctgttttttaaaaaatagttcttatgaggtgttaagaaaagctttcgcttggattcatacacagttgacccttgaacaacacaggtttggactgcgcagagccacttacacctggattttttcaatacatatattggaaaattttttggagatttgtatcactttgaaaaaacttagatgaaactcggatgaacttttcaattaaaatattgaaaaaaatgaagaaaaaggtatgtcataaatgcagaaaatgtatacagatactagtctactttatcatttcctaccataccaatagttaactattttaactattaaaagttaaaaattt

SEQ ID NO: 373801 - DNA, 2804 bp, Homo sapiens
agcggagcgtgcgggtggcctggatcccgcgcagtggcccggcgatgtcgctcgtgctgctaagcctggccgcgctgtgcaggagcgccgtaccccgagagccgaccgttcaatgtggctctgaaactgggccatctccagagtggatgctacaacatgatctaatccccggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacagctgtgtgaggtgcaattacacagaggccttccagactcagaccagaccctctggtggtaaatggacattttcctatatcggcttccctgtagagctgaacacagtctatttcattggggcccataatattcctaatgcaaatatgaatgaagatggcccttccatgtctgtgaatttcacctcaccaggctgcctagaccacataatgaaatataaaaaaaagtgtgtcaaggccggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcagctgactccatattttcctacttgtggcagcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaacaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaaccttctattacatgcaaaaaatcattgtttttaagataacaaaagtagggaataaacaagctgaacccacttttactggaccaaatgatctattatatgtgtaaccacttgtatgatttggtatttgcataagaccttccctctacaaactagattcatatcttgattcttgtacaggtgccttttaacatgaacaacaaaatacccacaaacttgtctacttttgcctaaagttacctattagaggtcactgtcagagttctcagtttcttagttactatttaacttttcatgttcaaaatgaaaataattcttaagttgaaagccctcttgaagtaacctttttataaatgagttattataatggtttacttaaaaaaaaaacaggggtgggtgcagtggctcatgcctccaatcccagcactttggcaaggccaaggcaaaaggatcgctcaagaccaggctacgtcacaaagcgagacctccatctctacaaaagatttaaaaaattagctgagtgtgatggtgtaagcctgtggtcccagctactagggaggctgagatgggaggatcacttgagccctggaggtcaagggtgcagtaaacggtgattgtgccactgcactccatcctgggtgagagcagaccctgtctaaaacaaacaaacgaaaaaacccccacagaatgacagaacataaaagatgcacattttgtcttccaactttttactcttctaaaagcatcttttttaaattttttaaattttttttttttgagacagagtttcactctgtcacccaggctggagtgcagtggcgtgacctcggctcacta

SEQ ID NO: 373802 - DNA, 3724 bp, Homo sapiens
  misc_feature (928)..(928): n is a, c, g, or t
  misc_feature (1277)..(1277): n is a, c, g, or t
  misc_feature (1292)..(1292): n is a, c, g, or t
  misc_feature (1323)..(1323): n is a, c, g, or t
  misc_feature (1330)..(1330): n is a, c, g, or t
  misc_feature (1407)..(1407): n is a, c, g, or t
agcggagcgtgcgggtggcctggatcccgcgcagtggcccggcgatgtcgctcgtgctgctaagcctggccgcgctgtgcaggagcgccgtaccccgagagccgaccgttcaatgtggctctgaaactgggccatctccagagtggatgctacaacatgatctaatccccggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacagctgtgtgaggtgcaattacacagaggccttccagactcagaccagaccctctggtggtaaatggacattttcctatatcggcttccctgtagagctgaacacagtctatttcattggggcccataatattcctaatgcaaatatgaatgaagatggcccttccatgtctgtgaatttcacctcaccaggctgcctagaccacataatgaaatataaaaaaaagtgtgtcaaggccggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcaggtaaagttcagtgagctgctctggggagggaagggacatagaagactgttccatcattcattgcttttaaggatgagttctctcttgtcaaatgcacttctgccagcagacaccagttaagtggcgttcatgggggntctttcgctgcagcctccaccgtgctgaggtcaggaggccgacgtggcagttgtggtcccttttgcttgtattaatggctgctgaccttccaaagcactttttattttcattttctgtcacagacactcagggatagcagtaccattttacttccgcaagcctttaactgcaagatgaagctgcaaagggtttgaaatgggaaggtttgagttccaggcagcgtatgaactctggagaggggctgccagtcctctctgggccgcagcggacccagctggaacacaggaagttggagcagtaggtgctccttcacctctcagtatgtctctttcaactctagtttttgangtggggacacaggangtccagtgggacacagccactccccaaagantaaggancttccatgcttcattccctggcataaaaagtgctcaaacacaccagagggggcaggcaccagccagggtatgatggntactacccttttctggagaaccatagacttcccttactacagggacttgcatgtcctaaagcactggctgaaggaagccaagaggatcactgctgctccttttttctagaggaaatgtttgtctacgtggtaagatatgacctagcccttttaggtaagcgaactggtatgttagtaacgtgtacaaagtttaggttcagaccccgggagtcttgggcatgtgggtctcgggtcactggttttgactttagggctttgttacagatgtgtgaccaaggggaaaatgtgcatgacaacactagagctgactccatattttcctacttgtggcagcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaacaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaaccttctattacatgcaaaaaatcattgtttttaagataacaaaagtagggaataaacaagctgaacccacttttactggaccaaatgatctattatatgtgtaaccacttgtatgatttggtatttgcataagaccttccctctacaaactagattcatatcttgattcttgtacaggtgccttttaacatgaacaacaaaatacccacaaacttgtctacttttgcctaaagttacctattagaggtcactgtcagagttctcagtttcttagttactatttaacttttcatgttcaaaatgaaaataattcttaagttgaaagccctcttgaagtaacctttttataaatgagttattataatggtttacttaaaaaaaaaacaggggtgggtgcagtggctcatgcctccaatcccagcactttggcaaggccaaggcaaaaggatcgctcaagaccaggctacgtcacaaagcgagacctccatctctacaaaagatttaaaaaattagctgagtgtgatggtgtaagcctgtggtcccagctactagggaggctgagatgggaggatcacttgagccctggaggtcaagggtgcagtaaacggtgattgtgccactgcactccatcctgggtgagagcagaccctgtctaaaacaaacaaacgaaaaaacccccacagaatgacagaacataaaagatgcacattttgtcttccaactttttactcttctaaaagcatcttttttaaattttttaaattttttttttttgagacagagtttcactctgtcacccaggctggagtgcagtggcgtgacctcggctcacta

SEQ ID NO: 373803 - DNA, 3746 bp, Homo sapiens
  misc_feature (928)..(928): n is a, c, g, or t
  misc_feature (1277)..(1277): n is a, c, g, or t
  misc_feature (1292)..(1292): n is a, c, g, or t
  misc_feature (1323)..(1323): n is a, c, g, or t
  misc_feature (1330)..(1330): n is a, c, g, or t
  misc_feature (1407)..(1407): n is a, c, g, or t
  misc_feature (1715)..(1715): n is a, c, g, or t
agcggagcgtgcgggtggcctggatcccgcgcagtggcccggcgatgtcgctcgtgctgctaagcctggccgcgctgtgcaggagcgccgtaccccgagagccgaccgttcaatgtggctctgaaactgggccatctccagagtggatgctacaacatgatctaatccccggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacagctgtgtgaggtgcaattacacagaggccttccagactcagaccagaccctctggtggtaaatggacattttcctatatcggcttccctgtagagctgaacacagtctatttcattggggcccataatattcctaatgcaaatatgaatgaagatggcccttccatgtctgtgaatttcacctcaccaggctgcctagaccacataatgaaatataaaaaaaagtgtgtcaaggccggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcaggtaaagttcagtgagctgctctggggagggaagggacatagaagactgttccatcattcattgcttttaaggatgagttctctcttgtcaaatgcacttctgccagcagacaccagttaagtggcgttcatgggggntctttcgctgcagcctccaccgtgctgaggtcaggaggccgacgtggcagttgtggtcccttttgcttgtattaatggctgctgaccttccaaagcactttttattttcattttctgtcacagacactcagggatagcagtaccattttacttccgcaagcctttaactgcaagatgaagctgcaaagggtttgaaatgggaaggtttgagttccaggcagcgtatgaactctggagaggggctgccagtcctctctgggccgcagcggacccagctggaacacaggaagttggagcagtaggtgctccttcacctctcagtatgtctctttcaactctagtttttgangtggggacacaggangtccagtgggacacagccactccccaaagantaaggancttccatgcttcattccctggcataaaaagtgctcaaacacaccagagggggcaggcaccagccagggtatgatggntactacccttttctggagaaccatagacttcccttactacagggacttgcatgtcctaaagcactggctgaaggaagccaagaggatcactgctgctccttttttctagaggaaatgtttgtctacgtggtaagatatgacctagcccttttaggtaagcgaactggtatgttagtaacgtgtacaaagtttaggttcagaccccgggagtcttgggcatgtgggtctcgggtcactggttttgactttagggctttgttacagatgtgtgaccaaggggaaaatgtgcatgacaacactagaggtangggcgaagccagaaagaagggaagttttggctgaagtaggagtcttgcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaacaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaaccttctattacatgcaaaaaatcattgtttttaagataacaaaagtagggaataaacaagctgaacccacttttactggaccaaatgatctattatatgtgtaaccacttgtatgatttggtatttgcataagaccttccctctacaaactagattcatatcttgattcttgtacaggtgccttttaacatgaacaacaaaatacccacaaacttgtctacttttgcctaaagttacctattagaggtcactgtcagagttctcagtttcttagttactatttaacttttcatgttcaaaatgaaaataattcttaagttgaaagccctcttgaagtaacctttttataaatgagttattataatggtttacttaaaaaaaaaacaggggtgggtgcagtggctcatgcctccaatcccagcactttggcaaggccaaggcaaaaggatcgctcaagaccaggctacgtcacaaagcgagacctccatctctacaaaagatttaaaaaattagctgagtgtgatggtgtaagcctgtggtcccagctactagggaggctgagatgggaggatcacttgagccctggaggtcaagggtgcagtaaacggtgattgtgccactgcactccatcctgggtgagagcagaccctgtctaaaacaaacaaacgaaaaaacccccacagaatgacagaacataaaagatgcacattttgtcttccaactttttactcttctaaaagcatcttttttaaattttttaaattttttttttttgagacagagtttcactctgtcacccaggctggagtgcagtggcgtgacctcggctcacta

SEQ ID NO: 373804 - DNA, 2358 bp, Homo sapiens
agcggagcgtgcgggtggcctggatcccgcgcagtggcccggcgatgtcgctcgtgctgctaagcctggccgcgctgtgcaggagcgccgtaccccgagagccgaccgttcaatgtggctctgaaactgggccatctccagagtggatgctacaacatgatctaatccccggagacttgagggacctccgagtagaacctgttacaactagtgttgcaacaggggactattcaattttgatgaatgtaagctgggtactccgggcagatgccacaccagaagaaacaaacgcgagcttcagtggtgattccagtgactggggatagtgaaggtgctacggtgcagctgactccatattttcctacttgtggcagcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaacaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaaccttctattacatgcaaaaaatcattgtttttaagataacaaaagtagggaataaacaagctgaacccacttttactggaccaaatgatctattatatgtgtaaccacttgtatgatttggtatttgcataagaccttccctctacaaactagattcatatcttgattcttgtacaggtgccttttaacatgaacaacaaaatacccacaaacttgtctacttttgcctaaagttacctattagaggtcactgtcagagttctcagtttcttagttactatttaacttttcatgttcaaaatgaaaataattcttaagttgaaagccctcttgaagtaacctttttataaatgagttattataatggtttacttaaaaaaaaaacaggggtgggtgcagtggctcatgcctccaatcccagcactttggcaaggccaaggcaaaaggatcgctcaagaccaggctacgtcacaaagcgagacctccatctctacaaaagatttaaaaaattagctgagtgtgatggtgtaagcctgtggtcccagctactagggaggctgagatgggaggatcacttgagccctggaggtcaagggtgcagtaaacggtgattgtgccactgcactccatcctgggtgagagcagaccctgtctaaaacaaacaaacgaaaaaacccccacagaatgacagaacataaaagatgcacattttgtcttccaactttttactcttctaaaagcatcttttttaaattttttaaattttttttttttgagacagagtttcactctgtcacccaggctggagtgcagtggcgtgacctcggctcacta

SEQ ID NO: 373805 - DNA, 2079 bp, Homo sapiens
ccgaggtcacgcccactgcactccagcctgggcgacagagtgagactatgtcccccaaaaaaaaaaagttaaggtttaagcatcagtgtgtttcaggtgatgtgttcaaaaggaacatcaggatgtttttccttgctgtcactaacaaggcccttggtgctcagctgacattctctagcaagggatcatttgtcagggatggtttacagagtgaaagcctgctgtttgctgttcacagataacaaatgcttttctcctctcacagaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaacaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaaccttctattacatgcaaaaaatcattgtttttaagataacaaaagtagggaataaacaagctgaacccacttttactggaccaaatgatctattatatgtgtaaccacttgtatgatttggtatttgcataagaccttccctctacaaactagattcatatcttgattcttgtacaggtgccttttaacatgaacaacaaaatacccacaaacttgtctacttttgcctaaagttacctattagaggtcactgtcagagttctcagtttcttagttactatttaacttttcatgttcaaaatgaaaataattcttaagttgaaagccctcttgaagtaacctttttataaatgagttattataatggtttacttaaaaaaaaaacaggggtgggtgcagtggctcatgcctccaatcccagcactttggcaaggccaaggcaaaaggatcgctcaagaccaggctacgtcacaaagcgagacctccatctctacaaaagatttaaaaaattagctgagtgtgatggtgtaagcctgtggtcccagctactagggaggctgagatgggaggatcacttgagccctggaggtcaagggtgcagtaaacggtgattgtgccactgcactccatcctgggtgagagcagaccctgtctaaaacaaacaaacgaaaaaacccccacagaatgacagaacataaaagatgcacattttgtcttccaactttttactcttctaaaagcatcttttttaaattttttaaattttttttttttgagacagagtttcactctgtcacccaggctggagtgcagtggcgtgacctcggctcacta

SEQ ID NO: 373806 - DNA, 1648 bp, Homo sapiens
agcggagcgtgcgggtggcctggatcccgcgcagtggcccggcgatgtcgctcgtgctgctaagcctggccgcgctgtgcaggagcgccgtaccccgagagccgaccgttcaatgtggctctgaaactgggccatctccagagtggatgctacaacatgatctaatccccggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacagctgtgtgaggtgcaattacacagaggccttccagactcagaccagaccctctggtggtaaatggacattttcctatatcggcttccctgtagagctgaacacagtctatttcattggggcccataatattcctaatgcaaatatgaatgaagatggcccttccatgtctgtgaatttcacctcaccaggctgcctagaccacataatgaaatataaaaaaaagtgtgtcaaggccggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcagctgactccatattttcctacttgtggcagcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgggtaagggttataattctttaaagacatcctagtaaggaaataacattttgaatttttttttaaagaagattcctctggaggcaatcacatgttggcgtttcccagagttagatagcatttatgtaataccttcaagtgctcctacagagactgatacgagcatgactggattacacatgccaggtgaaagcagggtcaggacttccagatcttctgactgtcccgtttttatttttaccattgagccttctaccagtactgaaatgggcaaaagatggctgataacaaattacactttacctgtgatggttactctatgctagttcctgttttttaaaaaatagttcttatgaggtgttaagaaaagctttcgcttggattcatacacagttgacccttgaacaacacaggtttggactgcgcagagccacttacacctggattttttcaatacatatattggaaaattttttggagatttgtatcactttgaaaaaacttagatgaaactcggatgaacttttcaattaaaatattgaaaaaaatgaagaaaaaggtatgtcataaatgcagaaaatgtatacagatactagtctactttatcatttcctaccataccaatagttaactattttaactattaaaagttaaaaattt

SEQ ID NO: 373807 - DNA, 2865 bp, Homo sapiens
  misc_feature (928)..(928): n is a, c, g, or t
  misc_feature (1277)..(1277): n is a, c, g, or t
  misc_feature (1292)..(1292): n is a, c, g, or t
  misc_feature (1323)..(1323): n is a, c, g, or t
  misc_feature (1330)..(1330): n is a, c, g, or t
  misc_feature (1407)..(1407): n is a, c, g, or t
  misc_feature (1715)..(1715): n is a, c, g, or t
agcggagcgtgcgggtggcctggatcccgcgcagtggcccggcgatgtcgctcgtgctgctaagcctggccgcgctgtgcaggagcgccgtaccccgagagccgaccgttcaatgtggctctgaaactgggccatctccagagtggatgctacaacatgatctaatccccggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacagctgtgtgaggtgcaattacacagaggccttccagactcagaccagaccctctggtggtaaatggacattttcctatatcggcttccctgtagagctgaacacagtctatttcattggggcccataatattcctaatgcaaatatgaatgaagatggcccttccatgtctgtgaatttcacctcaccaggctgcctagaccacataatgaaatataaaaaaaagtgtgtcaaggccggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcaggtaaagttcagtgagctgctctggggagggaagggacatagaagactgttccatcattcattgcttttaaggatgagttctctcttgtcaaatgcacttctgccagcagacaccagttaagtggcgttcatgggggntctttcgctgcagcctccaccgtgctgaggtcaggaggccgacgtggcagttgtggtcccttttgcttgtattaatggctgctgaccttccaaagcactttttattttcattttctgtcacagacactcagggatagcagtaccattttacttccgcaagcctttaactgcaagatgaagctgcaaagggtttgaaatgggaaggtttgagttccaggcagcgtatgaactctggagaggggctgccagtcctctctgggccgcagcggacccagctggaacacaggaagttggagcagtaggtgctccttcacctctcagtatgtctctttcaactctagtttttgangtggggacacaggangtccagtgggacacagccactccccaaagantaaggancttccatgcttcattccctggcataaaaagtgctcaaacacaccagagggggcaggcaccagccagggtatgatggntactacccttttctggagaaccatagacttcccttactacagggacttgcatgtcctaaagcactggctgaaggaagccaagaggatcactgctgctccttttttctagaggaaatgtttgtctacgtggtaagatatgacctagcccttttaggtaagcgaactggtatgttagtaacgtgtacaaagtttaggttcagaccccgggagtcttgggcatgtgggtctcgggtcactggttttgactttagggctttgttacagatgtgtgaccaaggggaaaatgtgcatgacaacactagaggtangggcgaagccagaaagaagggaagttttggctgaagtaggagtcttggtgagattttgctctgatgcatggtgtgaactttctgagcctcttgtttttcctcagctgactccatattttcctacttgtggcagcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaacaataaagcatcttcagcc

SEQ ID NO: 373808 - DNA, 2535 bp, Homo sapiens
agcggagcgtgcgggtggcctggatcccgcgcagtggcccggcgatgtcgctcgtgctgctaagcctggccgcgctgtgcaggagcgccgtaccccgagagccgaccgttcaatgtggctctgaaactgtggacattttcctatatcggcttccctgtagagctgaacacagtctatttcattggggcccataatattcctaatgcaaatatgaatgaagatggcccttccatgtctgtgaatttcacctcaccaggctgcctagaccacataatgaaatataaaaaaaagtgtgtcaaggccggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcagctgactccatattttcctacttgtggcagcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaacaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaaccttctattacatgcaaaaaatcattgtttttaagataacaaaagtagggaataaacaagctgaacccacttttactggaccaaatgatctattatatgtgtaaccacttgtatgatttggtatttgcataagaccttccctctacaaactagattcatatcttgattcttgtacaggtgccttttaacatgaacaacaaaatacccacaaacttgtctacttttgcctaaagttacctattagaggtcactgtcagagttctcagtttcttagttactatttaacttttcatgttcaaaatgaaaataattcttaagttgaaagccctcttgaagtaacctttttataaatgagttattataatggtttacttaaaaaaaaaacaggggtgggtgcagtggctcatgcctccaatcccagcactttggcaaggccaaggcaaaaggatcgctcaagaccaggctacgtcacaaagcgagacctccatctctacaaaagatttaaaaaattagctgagtgtgatggtgtaagcctgtggtcccagctactagggaggctgagatgggaggatcacttgagccctggaggtcaagggtgcagtaaacggtgattgtgccactgcactccatcctgggtgagagcagaccctgtctaaaacaaacaaacgaaaaaacccccacagaatgacagaacataaaagatgcacattttgtcttccaactttttactcttctaaaagcatcttttttaaattttttaaattttttttttttgagacagagtttcactctgtcacccaggctggagtgcagtggcgtgacctcggctcacta

SEQ ID NO: 373809 - DNA, 2756 bp, Homo sapiens
agcggagcgtgcgggtggcctggatcccgcgcagtggcccggcgatgtcgctcgtgctgctaagcctggccgcgctgtgcaggagcgccgtaccccgagagccgaccgttcaatgtggctctgaaactgggccatctccagagtggatgctacaacatgatctaatccccggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacagctgtgtgaggtgcaattacacagaggccttccagactcagaccagaccctctggtggtaaatggacattttcctatatcggcttccctgtagagctgaacacagtctatttcattggggcccataatattcctaatgcaaatatgaatgaagatggcccttccatgtctgtgaatttcacctcaccaggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcagctgactccatattttcctacttgtggcagcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaacaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaaccttctattacatgcaaaaaatcattgtttttaagataacaaaagtagggaataaacaagctgaacccacttttactggaccaaatgatctattatatgtgtaaccacttgtatgatttggtatttgcataagaccttccctctacaaactagattcatatcttgattcttgtacaggtgccttttaacatgaacaacaaaatacccacaaacttgtctacttttgcctaaagttacctattagaggtcactgtcagagttctcagtttcttagttactatttaacttttcatgttcaaaatgaaaataattcttaagttgaaagccctcttgaagtaacctttttataaatgagttattataatggtttacttaaaaaaaaaacaggggtgggtgcagtggctcatgcctccaatcccagcactttggcaaggccaaggcaaaaggatcgctcaagaccaggctacgtcacaaagcgagacctccatctctacaaaagatttaaaaaattagctgagtgtgatggtgtaagcctgtggtcccagctactagggaggctgagatgggaggatcacttgagccctggaggtcaagggtgcagtaaacggtgattgtgccactgcactccatcctgggtgagagcagaccctgtctaaaacaaacaaacgaaaaaacccccacagaatgacagaacataaaagatgcacattttgtcttccaactttttactcttctaaaagcatcttttttaaattttttaaattttttttttttgagacagagtttcactctgtcacccaggctggagtgcagtggcgtgacctcggctcacta

SEQ ID NO: 373810 - DNA, 2749 bp, Homo sapiens
agcggagcgtgcgggtggcctggatcccgcgcagtggcccggcgatgtcgctcgtgctgctaagcctggccgcgctgtgcaggagcgccgtaccccgagagccgaccgttcaatgtggctctgaaactgggccatctccagagtggatgctacaacatgatctaatccccggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacagctgtgtgaggtgcaattacacagaggccttccagactcagaccagaccctctggtggtaaatggacattttcctatatcggcttccctgtagagctgaacacagtctatttcattggggcccataatattcctaatgcaaatatgaatgaagatggcccttccatgtctgtgaatttcacctcaccaggctgcctagaccacataatgaaatataaaaaaaagtgtgtcaaggccggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcagctgactccatattttcctacttgtggcagcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgtcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaacaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaaccttctattacatgcaaaaaatcattgtttttaagataacaaaagtagggaataaacaagctgaacccacttttactggaccaaatgatctattatatgtgtaaccacttgtatgatttggtatttgcataagaccttccctctacaaactagattcatatcttgattcttgtacaggtgccttttaacatgaacaacaaaatacccacaaacttgtctacttttgcctaaagttacctattagaggtcactgtcagagttctcagtttcttagttactatttaacttttcatgttcaaaatgaaaataattcttaagttgaaagccctcttgaagtaacctttttataaatgagttattataatggtttacttaaaaaaaaaacaggggtgggtgcagtggctcatgcctccaatcccagcactttggcaaggccaaggcaaaaggatcgctcaagaccaggctacgtcacaaagcgagacctccatctctacaaaagatttaaaaaattagctgagtgtgatggtgtaagcctgtggtcccagctactagggaggctgagatgggaggatcacttgagccctggaggtcaagggtgcagtaaacggtgattgtgccactgcactccatcctgggtgagagcagaccctgtctaaaacaaacaaacgaaaaaacccccacagaatgacagaacataaaagatgcacattttgtcttccaactttttactcttctaaaagcatcttttttaaattttttaaattttttttttttgagacagagtttcactctgtcacccaggctggagtgcagtggcgtgacctcggctcacta

SEQ ID NO: 373811 - DNA, 871 bp, Homo sapiens
cgcttctccttctcccccggcccctagatggcccttccctgacctagaaagagggagacagagtttcataggggaggcaaaatggagactccgtggcttgggggtggggggaatggaggcccaaagggtaggaaggagacctagaaagaggggtgagatggagacccagggagaagtagtggcaaagaaagatggtgagatggggccttgcaaggctataaccaaattcaaatcctggctctgctagttactaatggggtgattgggcaagtcatttaacctctctgtgatcttgggaaaatcacttaacttctttgggccttactctccttatggacaaaaaggggatgacaacaggcctggcacacagggtgtttttcaggattatgaaagttaataaaactgctgaggtcaatattttgcacataataagtgctcaataaaaattagccttcactcctattatagcatacatattgtgtgcaaccagatggactggctggggcagtgattaaaatgacttatctactcttccccccacccgccagggaggcccctgcctcttggttctcaggcacattgagcctggaagggcctcctgcagttggctgtcaatgctgctcctcacttacctctcctccacagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccaggtaagggaccatctaaaagccaagatcctcatactgtggaaagacaaaatctgaagcttttctttaaaaaaaaa

SEQ ID NO: 373812 - DNA, 2692 bp, Homo sapiens
  misc_feature (2690)..(2692): n is a, c, g, or t
ggggaacaaaggtgagcgaaaggaggaggcagaatccgggcagagggcagggagagggcctgtggggaagggacctcagtcctgctcccacccgctccctggagagcaggcggccagacacccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctcaaaaaaannn

SEQ ID NO: 373813 - DNA, 3719 bp, Homo sapiens
  misc_feature (3717)..(3719): n is a, c, g, or t
caaaaatctttttaataagagagtaggatccagggttagtttttgtagcctcggctggcccgtcggcctctggcacgctcgaacttccgcccttggagcggacgtagggtttggtgttgctgtgcggggttcctggggccttgccgatatgccggtacacctctcggcccttgcgaggaccggagagcaggacagtgccacagcccttaggggagtccagggccagctggtcgaaagtgaggatcttgccccctgccctgaggatgcggctgcgggcccggctggtcacgcgcagtgcacataccttcagtttgggtacctcctgaacccgcacatcatcagttatggtccccacaaccacgccgtcttgttttcccggccaggaagcttcatcttccggatcatccgggaaagggacagaggcggccggttggtgcgactcataaacaacctcttcaacacaacctggttgaatgtggagttggttcttctggccagaaacctgtataacttgaccaacagcctcaggtagatatcctggctcttgggctccttgcgccgaacctttcggtccttgttatggcggatgtccactcccatgatggcgcctcctgctcggccaggtccggaaagagagaacgggctggggtgggcggggaaagcctcaagcgagtggcgccgccgtgacgtcacatgggtgcgacgcggcgctctaccacgatccggacttctctgtggtgagttggacgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctcaaaaaaannn

SEQ ID NO: 373814 - DNA, 3865 bp, Homo sapiens
  misc_feature (3863)..(3865): n is a, c, g, or t
caaaaatctttttaataagagagtaggatccagggttagtttttgtagcctcggctggcccgtcggcctctggcacgctcgaacttccgcccttggagcggacgtagggtttggtgttgctgtgcggggttcctggggccttgccgatatgccggtacacctctcggcccttgcgaggaccggagagcaggacagtgccacagcccttaggggagtccagggccagctggtcgaaagtgaggatcttgccccctgccctgaggatgcggctgcgggcccggctggtcacgcgcagtgcacataccttcagtttgggtacctcctgaacccgcacatcatcagttatggtccccacaaccacgccgtcttgttttcccggccaggaagcttcatcttccggatcatccgggaaagggacagaggcggccggttggtgcgactcataaacaacctcttcaacacaacctggttgaatgtggagttggttcttctggccagaaacctgtataacttgaccaacagcctcaggtagatatcctggctcttgggctccttgcgccgaacctttcggtccttgttatggcggatgtccactcccatgatggcgcctcctgctcggccaggtccggaaagagagaacgggctggggtgggcggggaaagcctcaagcgagtggcgccgccgtgacgtcacatgggtgcgacgcggcgctctaccacgatccggacttctctgtggtgagttggacgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggaggtgaggaggcggggctggcagggctagtcggggcatctggaaatttccgaccccacgcttcgggcgtttccttatcaggttcaccgctccctgatctcgcgctgcacttcgtaggcgcagccgctgcttgggaagtcctacttaagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctcaaaaaaannn

SEQ ID NO: 373815 - DNA, 2771 bp, Homo sapiens
  misc_feature (18)..(18): n is a, c, g, or t
  misc_feature (27)..(27): n is a, c, g, or t
  misc_feature (2769)..(2771): n is a, c, g, or t
gcaggctggtactggccngggagttanggcatggcgggcccagtgttggatgagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctcaaaaaaannn

SEQ ID NO: 373816 - DNA, 3589 bp, Homo sapiens
  misc_feature (3587)..(3589): n is a, c, g, or t
caaaaatctttttaataagagagtaggatccagggttagtttttgtagcctcggctggcccgtcggcctctggcacgctcgaacttccgcccttggagcggacgtagggtttggtgttgctgtgcggggttcctggggccttgccgatatgccggtacacctctcggcccttgcgaggaccggagagcaggacagtgccacagcccttaggggagtccagggccagctggtcgaaagtgaggatcttgccccctgccctgaggatgcggctgcgggcccggctggtcacgcgcagtgcacataccttcagtttgggtacctcctgaacccgcacatcatcagttatggtccccacaaccacgccgtcttgttttcccggccaggaagcttcatcttccggatcatccgggaaagggacagaggcggccggttggtgcgactcataaacaacctcttcaacacaacctggttgaatgtggagttggttcttctggccagaaacctgtataacttgaccaacagcctcaggtagatatcctggctcttgggctccttgcgccgaacctttcggtccttgttatggcggatgtccactcccatgatggcgcctcctgctcggccaggtccggaaagagagaacgggctggggtgggcggggaaagcctcaagcgagtggcgccgccgtgacgtcacatgggtgcgacgcggcgctctaccacgatccggacttctctgtggtgagttggacgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctcaaaaaaannn

SEQ ID NO: 373817 - DNA, 4122 bp, Homo sapiens
  misc_feature (4120)..(4122): n is a, c, g, or t
caaaaatctttttaataagagagtaggatccagggttagtttttgtagcctcggctggcccgtcggcctctggcacgctcgaacttccgcccttggagcggacgtagggtttggtgttgctgtgcggggttcctggggccttgccgatatgccggtacacctctcggcccttgcgaggaccggagagcaggacagtgccacagcccttaggggagtccagggccagctggtcgaaagtgaggatcttgccccctgccctgaggatgcggctgcgggcccggctggtcacgcgcagtgcacataccttcagtttgggtacctcctgaacccgcacatcatcagttatggtccccacaaccacgccgtcttgttttcccggccaggaagcttcatcttccggatcatccgggaaagggacagaggcggccggttggtgcgactcataaacaacctcttcaacacaacctggttgaatgtggagttggttcttctggccagaaacctgtataacttgaccaacagcctcaggtagatatcctggctcttgggctccttgcgccgaacctttcggtccttgttatggcggatgtccactcccatgatggcgcctcctgctcggccaggtccggaaagagagaacgggctggggtgggcggggaaagcctcaagcgagtggcgccgccgtgacgtcacatgggtgcgacgcggcgctctaccacgatccggacttctctgtggtgagttggacgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacggggggtaggttgaggataccacgaagggagggatgagcccctcctggggtgatagggacccctatatctcccactcagccaaacccacagtcagtcaagtaaatcagcctgcctgtgggatgctcacccccagctcctggacatttttgcctgcctgcttcccagctgtatcccgagcgcccagaactctgcctggcatgggaggcactcagtgaattgtagggagcaaatgaaagatgaccaggaacctggccccgtaaggagtcgcctggaggtggccccacggctgtggtgggcctgggccatggccttcgtggtctcattgccagctgctttcctacctgtctctttccccaacccctgtttgctccttccttctgtgtgtccgtccatctccggctgtgaagatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctcaaaaaaannn

SEQ ID NO: 373818 - DNA, 3650 bp, Homo sapiens
  misc_feature (3648)..(3650): n is a, c, g, or t
caaaaatctttttaataagagagtaggatccagggttagtttttgtagcctcggctggcccgtcggcctctggcacgctcgaacttccgcccttggagcggacgtagggtttggtgttgctgtgcggggttcctggggccttgccgatatgccggtacacctctcggcccttgcgaggaccggagagcaggacagtgccacagcccttaggggagtccagggccagctggtcgaaagtgaggatcttgccccctgccctgaggatgcggctgcgggcccggctggtcacgcgcagtgcacataccttcagtttgggtacctcctgaacccgcacatcatcagttatggtccccacaaccacgccgtcttgttttcccggccaggaagcttcatcttccggatcatccgggaaagggacagaggcggccggttggtgcgactcataaacaacctcttcaacacaacctggttgaatgtggagttggttcttctggccagaaacctgtataacttgaccaacagcctcaggtagatatcctggctcttgggctccttgcgccgaacctttcggtccttgttatggcggatgtccactcccatgatggcgcctcctgctcggccaggtccggaaagagagaacgggctggggtgggcggggaaagcctcaagcgagtggcgccgccgtgacgtcacatgggtgcgacgcggcgctctaccacgatccggacttctctgtggtgagttggacgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacggggggtaggttgaggataccacgaagggagggatgagcccctcctggggtgatagggacccctatatctcccactcagccaaacccacagtcagtcaagtaaatcagcctgcctgtgggatgctcacccccagctcctggacatttttgcctgcctgcttcccagctgtatcccgagcgcccagaactctgcctggcatgggaggcactcagtgaattgtagggagcaaatgaaagatgaccaggaacctggccccgtaaggagtcgcctggaggtggccccacggctgtggtgggcctgggccatggccttcgtggtctcattgccagctgctttcctacctgtctctttccccaacccctgtttgctccttccttctgtgtgtccgtccatctccggctgtgaagatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctcaaaaaaannn

SEQ ID NO: 373819 - DNA, 2774 bp, Homo sapiens
  misc_feature (2772)..(2774): n is a, c, g, or t
gggactgagggaccaagaggaacagagactcaggcccgggactggggcaccggggtgggagatggaaatggaaaacctgggccaggactgaacccagccaggcctgggactgggttctggaaataagagtgcggatggcggtttgggggcccagggccagacacgcaggcctatggattggggaccaatggatggagacccaggtccaggtctcggggacccagggacagagacccaggcccaagactggaggacatctagggctctgtgcttgaacctgatttgaggttcccataatggggccagggcaggtttgggggtgaagcagacgtcctggacccgagagagccgctggggataggggggcagatgtagttcctaagggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctcaaaaaaannn

SEQ ID NO: 373820 - DNA, 1585 bp, Homo sapiens
  misc_feature (1583)..(1585): n is a, c, g, or t
caaaaatctttttaataagagagtaggatccagggttagtttttgtagcctcggctggcccgtcggcctctggcacgctcgaacttccgcccttggagcggacgtagggtttggtgttgctgtgcggggttcctggggccttgccgatatgccggtacacctctcggcccttgcgaggaccggagagcaggacagtgccacagcccttaggggagtccagggccagctggtcgaaagtgaggatcttgccccctgccctgaggatgcggctgcgggcccggctggtcacgcgcagtgcacataccttcagtttgggtacctcctgaacccgcacatcatcagttatggtccccacaaccacgccgtcttgttttcccggccaggaagcttcatcttccggatcatccgggaaagggacagaggcggccggttggtgcgactcataaacaacctcttcaacacaacctggttgaatgtggagttggttcttctggccagaaacctgtataacttgaccaacagcctcaggtagatatcctggctcttgggctccttgcgccgaacctttcggtccttgttatggcggatgtccactcccatgatggcgcctcctgctcggccaggtccggaaagagagaacgggctggggtgggcggggaaagcctcaagcgagtggcgccgccgtgacgtcacatgggtgcgacgcggcgctctaccacgatccggacttctctgtggtgagttggacgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctgggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctcaaaaaaannn

SEQ ID NO: 373821 - DNA, 509 bp, Homo sapiens
gcgctctgggcctggggaatgtgaggggcaggactggcaggtggctgggcggggcagtggggaacaaaggtgagcgaaaggaggaggcagaatccgggcagagggcagggagagggcctgtggggaagggacctcagtcctgctcccacccgctccctggagagcaggcggccagacacccaggtcagtgctcagggaccagctcttggcccctgccccttgcaggcgctcgcatgtggctcctctcggaccccgtagtccctgtcatatcccttctctccagctgtctccatgcctgcctcgtacccctcctatttgctctcccttccactctgtcttgcctttctcgttggggtgaaaaagtcttactctcttaagtatctttcatcgcctgagtttcacctcattgaccctgtttgtctcctctcagtgtttctctggctctcagaccctatctctattgcgtttgtgattgttttgctgttttacccactgcaccgtatgggggg

SEQ ID NO: 373822 - DNA, 1162 bp, Homo sapiens
gtgctgacttgcgggaccgcctggaggaggacccggcgtaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggcccgcgggaggactcagactccagcacttccagcagcgcctgccctctatggacgacagcccggagctgcccacgggctgcagccagtatgccagggagctgccctcttcttccacaacagctggctctggggttctcaagatttattcaggatcgtgttaacggaggcggtgggaggatagggtccctgacgtgccggggacacacacagagaaccctccccgcccccgcaagggaggggggaggctcgctttttcttaaaaatataaatgtatttatctgcattatca

SEQ ID NO: 373823 - DNA, 3364 bp, Homo sapiens
  misc_feature (3362)..(3364): n is a, c, g, or t
cgcttctccttctcccccggcccctagatggcccttccctgacctagaaagagggagacagagtttcataggggaggcaaaatggagactccgtggcttgggggtggggggaatggaggcccaaagggtaggaaggagacctagaaagaggggtgagatggagacccagggagaagtagtggcaaagaaagatggtgagatggggccttgcaaggctataaccaaattcaaatcctggctctgctagttactaatggggtgattgggcaagtcatttaacctctctgtgatcttgggaaaatcacttaacttctttgggccttactctccttatggacaaaaaggggatgacaacaggcctggcacacagggtgtttttcaggattatgaaagttaataaaactgctgaggtcaatattttgcacataataagtgctcaataaaaattagccttcactcctattatagcatacatattgtgtgcaaccagatggactggctggggcagtgattaaaatgacttatctactcttccccccacccgccagggaggcccctgcctcttggttctcaggcacattgagcctggaagggcctcctgcagttggctgtcaatgctgctcctcacttacctctcctccacagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctcaaaaaaannn

SEQ ID NO: 373824 - DNA, 2275 bp, Homo sapiens
caaaaatctttttaataagagagtaggatccagggttagtttttgtagcctcggctggcccgtcggcctctggcacgctcgaacttccgcccttggagcggacgtagggtttggtgttgctgtgcggggttcctggggccttgccgatatgccggtacacctctcggcccttgcgaggaccggagagcaggacagtgccacagcccttaggggagtccagggccagctggtcgaaagtgaggatcttgccccctgccctgaggatgcggctgcgggcccggctggtcacgcgcagtgcacataccttcagtttgggtacctcctgaacccgcacatcatcagttatggtccccacaaccacgccgtcttgttttcccggccaggaagcttcatcttccggatcatccgggaaagggacagaggcggccggttggtgcgactcataaacaacctcttcaacacaacctggttgaatgtggagttggttcttctggccagaaacctgtataacttgaccaacagcctcaggtagatatcctggctcttgggctccttgcgccgaacctttcggtccttgttatggcggatgtccactcccatgatggcgcctcctgctcggccaggtccggaaagagagaacgggctggggtgggcggggaaagcctcaagcgagtggcgccgccgtgacgtcacatgggtgcgacgcggcgctctaccacgatccggacttctctgtggtgagttggacgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggcccgcgggaggactcagactccagcacttccagcagcgcctgccctctatggacgacagcccggagctgcccacgggctgcagccagtatgccagggagctgccctcttcttccacaacagctggctctggggttctcaagatttattcaggatcgtgttaacggaggcggtgggaggatagggtccctgacgtgccggggacacacacagagaaccctccccgcccccgcaagggaggggggaggctcgctttttcttaaaaatataaatgtatttatctgcattatca

SEQ ID NO: 373825 - DNA, 2609 bp, Homo sapiens
  misc_feature (2607)..(2609): n is a, c, g, or t
tacatctgctgttctcttgctagatttatgtttctgtctcctatcctcttcccctttgcatgggtcttgaccacaggtgagtcacccagggtggtgagagcagcagcctgagacaggaccaggtaccacccagagtgatgggtgccaacagaggtctagggcttccctggagttcagaggtggcatctaatcctgcctggggcccctaagggctggaagtaacctaatcctgggtaataggtgtttggggtgaggaaagtgggaaccacagctctgaactacagctcctcccacacatggggacaaagggcatttggtttcacacctaagccctgcctttgtctcagcagctaggagttggggcagggctgcatacctaggcctggccacatgagagccagcaggtcccaggggccagccctccaccaattccgttgggggctgatgaagggactgtttccaaggtggggggcctgggtcactggcctctgcagaccctaacctctctccacagagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctcaaaaaaannn

SEQ ID NO: 373826 - DNA, 2717 bp, Homo sapiens
  misc_feature (2715)..(2717): n is a, c, g, or t
caaaaatctttttaataagagagtaggatccagggttagtttttgtagcctcggctggcccgtcggcctctggcacgctcgaacttccgcccttggagcggacgtagggtttggtgttgctgtgcggggttcctggggccttgccgatatgccggtacacctctcggcccttgcgaggaccggagagcaggacagtgccacagcccttaggggagtccagggccagctggtcgaaagtgaggatcttgccccctgccctgaggatgcggctgcgggcccggctggtcacgcgcagtgcacataccttcagtttgggtacctcctgaacccgcacatcatcagttatggtccccacaaccacgccgtcttgttttcccggccaggaagcttcatcttccggatcatccgggaaagggacagaggcggccggttggtgcgactcataaacaacctcttcaacacaacctggttgaatgtggagttggttcttctggccagaaacctgtataacttgaccaacagcctcaggtagatatcctggctcttgggctccttgcgccgaacctttcggtccttgttatggcggatgtccactcccatgatggcgcctcctgctcggccaggtccggaaagagagaacgggctggggtgggcggggaaagcctcaagcgagtggcgccgccgtgacgtcacatgggtgcgacgcggcgctctaccacgatccggacttctctgtggtgagttggacgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggaggtgaggaggcggggctggcagggctagtcggggcatctggaaatttccgaccccacgcttcgggcgtttccttatcaggttcaccgctccctgatctcgcgctgcacttcgtaggcgcagccgctgcttgggaagtcctacttaagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctcaaaaaaannn

SEQ ID NO: 373827 - DNA, 1372 bp, Homo sapiens
caaaaatctttttaataagagagtaggatccagggttagtttttgtagcctcggctggcccgtcggcctctggcacgctcgaacttccgcccttggagcggacgtagggtttggtgttgctgtgcggggttcctggggccttgccgatatgccggtacacctctcggcccttgcgaggaccggagagcaggacagtgccacagcccttaggggagtccagggccagctggtcgaaagtgaggatcttgccccctgccctgaggatgcggctgcgggcccggctggtcacgcgcagtgcacataccttcagtttgggtacctcctgaacccgcacatcatcagttatggtccccacaaccacgccgtcttgttttcccggccaggaagcttcatcttccggatcatccgggaaagggacagaggcggccggttggtgcgactcataaacaacctcttcaacacaacctggttgaatgtggagttggttcttctggccagaaacctgtataacttgaccaacagcctcaggtagatatcctggctcttgggctccttgcgccgaacctttcggtccttgttatggcggatgtccactcccatgatggcgcctcctgctcggccaggtccggaaagagagaacgggctggggtgggcggggaaagcctcaagcgagtggcgccgccgtgacgtcacatgggtgcgacgcggcgctctaccacgatccggacttctctgtggtgagttggacgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggaggtgaggaggcggggctggcagggctagtcggggcatctggaaatttccgaccccacgcttcgggcgtttccttatcaggttcaccgctccctgatctcgcgctgcacttcgtaggcgcagccgctgcttgggaagtcctacttaagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccaggtaagggaccatctaaaagccaagatcctcatactgtggaaagacaaaatctgaagcttttctttaaaaaaaaa

SEQ ID NO: 373828 - DNA, 1739 bp, Homo sapiens
gcctgattccagaaggtaccttgggtctcactgtgtcatccagagctggagtgcagcggcacagtcatggctcactggaactcaggctcaagcaatcctcccgcctcagccttccaagtaactaggactacaggtgtctgagatgctgccaccgcagaagaagccctgggagtccatggctaaggggctggtgctgggcgcgctcttcactagtttcctgctgctgatgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaaaaaaaaa

SEQ ID NO: 373829 - DNA, 422 bp, Homo sapiens
  misc_feature (26)..(26): n is a, c, g, or t
  misc_feature (37)..(37): n is a, c, g, or t
atgattacgaaatttaaatacgactnaactaataggnaattttggccctcgaaggccaaagaaattcgggcacgagggcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaaaaaaaaa

SEQ ID NO: 373830 - DNA, 1671 bp, Homo sapiens
ggcagcctgggagttggacgtggctcaggcagtgggtagaaaggggcagccagccacagcccgaggtgtctgagatgctgccaccgcagaagaagccctgggagtccatggctaaggggctggtgctgggcgcgctcttcactagtttcctgctgctgatgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaaaaaaaaa

SEQ ID NO: 373831 - DNA, 1935 bp, Homo sapiens
tcagccagcttaaaaattaaaaggagtggaaagtttggggccctggttctctacccggttcattttaatttttaaattttaaccttctccctgccccattccccaacctctctttgagttgcttcacccaccgtctctgcaaccctggggctgtctctttccaggtggttgtcagtctatctctccagtgcctctctgtccctgtctggaccctgctggggggccacagagcaggcaaaggcagggctcaactgccaggcctgggcagccttgggggctccctggggccagcttcctgacacttgccctactctgtgctgcccctgcaggtgtctgagatgctgccaccgcagaagaagccctgggagtccatggctaaggggctggtgctgggcgcgctcttcactagtttcctgctgctgatgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaaaaaaaaa

SEQ ID NO: 373832 - DNA, 1800 bp, Homo sapiens
ggcagcctgggagttggacgtggctcaggcagtgggtagaaaggggcagccagccacagcccgagggtctcactgtgtcatccagagctggagtgcagcggcacagtcatggctcactggaactcaggctcaagcaatcctcccgcctcagccttccaagtaactaggactacaggcatgtgccaccacgcctggtgtctgagatgctgccaccgcagaagaagccctgggagtccatggctaaggggctggtgctgggcgcgctcttcactagtttcctgctgctgatgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaaaaaaaaa

SEQ ID NO: 373833 - DNA, 1629 bp, Homo sapiens
gcctgattccagaaggtaccttggtgtctgagatgctgccaccgcagaagaagccctgggagtccatggctaaggggctggtgctgggcgcgctcttcactagtttcctgctgctgatgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaaaaaaaaa

SEQ ID NO: 373834 - DNA, 1657 bp, Homo sapiens
cgcggcccgggccgagccagccacgctgaggcggaggaggacggggacaaggtgtctgagatgctgccaccgcagaagaagccctgggagtccatggctaaggggctggtgctgggcgcgctcttcactagtttcctgctgctgatgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccactacgacgaggtgcgcggcctggtgccgaccaacgccatcttcatcacggtgctccgcgaccccgcccgcttgttcgagtcctccttccactacttcgggccggtggtgcccctcacgtggaagctctcggccggcgacaagctgaccgagttcctgcaagacccggatcgctactacgaccccaacggcttcaatgcccactacctccgaaacctgctcttcttcgacctgggctatgacaacagcctggaccccagcagcccgcaggtgcaggagcacatcctggaggtggagcgtcgcttccacctggtgctccttcaagagtacttcgacgagtcgctggtgctgctgaaggacctgctgtgctgggagctggaggacgtgctctacttcaagctcaacgcccgccgcgactcgcccgtgccgcggctctcgggggagctgtatgggcgcgccaccgcctggaacatgctggactcccacctctaccgccacttcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaaaaaaaaa

SEQ ID NO: 373835 - DNA, 1290 bp, Homo sapiens
cgcggcccgggccgagccagccacgctgaggcggaggaggacggggacaagggtctcactgtgtcatccagagctggagtgcagcggcacagtcatggctcactggaactcaggctcaagcaatcctcccgcctcagccttccaagtaactaggactacaggcatgtgccaccacgcctggtgtctgagatgctgccaccgcagaagaagccctgggagtccatggctaaggggctggtgctgggcgcgctcttcactagtttcctgctgctgatgtactcctatgccgtgcccccgctgcatgccggcctggcctccacgaccccggaggccgcagcgtcctgctctccacctgcactcgagccagaggcagtgatccgggccaacggctcggcgggggagtgccagccgcggcgcaacatcgtgttcttgaagacgcacaagacggccagcagcaccctgctcaacatcctgttccgcttcggccagaagcaccggctcaagttcgccttccctaacggccgcaatgacttcgactacccgaccttcttcgcccgcagcctggtgcaggactatcggcccggggcctgcttcaacatcatctgcaaccacatgcgcttccattcaacgccagcttctggcgcaaggtggaggccttcgggcgggagcgcatggcccgcgaggtggccgccctgcgccatgccaacgagcgcatgcggaccatctgcatcgacgggggccacgccgtggacgccgccgccatccaggacgaggccatgcagccctggcagccgctgggcaccaagtccatcctgggctacaacctcaagaagagcatcgggcagcggcacgcgcagctctgccggcgcatgctcacgcccgagatccagtacctgatggacctcggcgccaacctgtgggtcaccaagctctggaagttcattcgcgatttcctgcggtggtgacgtcccaccgcccagcggcttgcctgcctgctcgctccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgttaaaaaaaaa

SEQ ID NO: 373836 - DNA, 1511 bp, Homo sapiens
gccccgcgcggatggcgacggaaggggaggccgctcggcctggcctggagggagacctcgctctgccccgcgtcccagccatggcgacatcctcggccgcgctgccccgaatactcggcgcgggtgcccgggccccgtcgcgctggttgggctttctcgggaaggcgaccccccggcctgctcggccgagccgcaggacgcttggaagcgcgacggcccttatgatccgcgagtcggaggacagcaccgatttcaacgacaagattttgaatgagcccctcaagcactctgacttcttcaatgtcaaggaactgttttccgtgagaagcctcttcgatgcccgagtccatctgggacacaaagctggctgtcggcacaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccgagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatgaga

SEQ ID NO: 373837 - DNA, 585 bp, Homo sapiens
gcagtcgttgttacttactcagctgaggatgccgctgacccaggctggggaaggggactcccagctcagacaggcttggctgtggtttgctttgggaggagagtgaacatccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccgagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatgaga

SEQ ID NO: 373838 - DNA, 458 bp, Homo sapiens
gccccgcgcggatggcgacggaaggggaggccgctcggcctggcctggagggagacctcgctctgccccgcgtcccagccatggcgacatcctcggccgcgctgccccgaatactcggcgcgggtgcccgggccccgtcgcgctggttgggctttctcgggaaggcgaccccccggcctgctcggccgagccgcaggacgcttggaagcgcgacggcccttatgatccgcgagtcggaggacagcaccgatttcaacgacaagattttgaatgagcccctcaagcactctgacttcttcaatgtcaaggaactgttttccgtgagaagcctcttcgatgcccgagtccatctgggacacaaagctggctgtcggcacagttttaggtgattacagccccatcctcctccacatgggaatacagagccccacagagaagcaggagtttattcctcagct

SEQ ID NO: 373839 - DNA, 1454 bp, Homo sapiens
taatttcatgcacgggcctggggcttagatcataattacatggccctcggtctgtcaatttccagggtgcccgggccccgtcgcgctggttgggctttctcgggaaggcgaccccccggcctgctcggccgagccgcaggacgcttggaagcgcgacggcccttatgatccgcgagtcggaggacagcaccgatttcaacgacaagattttgaatgagcccctcaagcactctgacttcttcaatgtcaaggaactgttttccgtgagaagcctcttcgatgcccgagtccatctgggacacaaagctggctgtcggcacaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccgagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatgaga

SEQ ID NO: 373840 - DNA, 1235 bp, Homo sapiens
gccccgcgcggatggcgacggaaggggaggccgctcggcctggcctggagggagacctcgctctgccccgcgtcccagccatggcgacatcctcggccgcgctgccccgaatactcggcgcgggtgcccgggccccgtcgcgctggttgggctttctcgggaaggcgaccccccggcctgctcggccgagccgcaggacgcttggaagcgcgacggcccttatgatccgcgagtcggaggacagcaccgatttcaacgacaagattttgaatgagcccctcaagcactctgacttcttcaatgtcaaggaactgttttccgtgagaagcctcttcgatgcccgagtccatctgggacacaaagctggctgtcggcacaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccagggggctgttttgtaatgagatgctgctggcaggccactcagaggctcccagctgggttggtgggacagccaggccagatgacctgattccagcaaaaataaaactcagatttgggcaaaatgaga

SEQ ID NO: 373841 - DNA, 1654 bp, Homo sapiens
gccccgcgcggatggcgacggaaggggaggccgctcggcctggcctggagggagacctcgctctgccccgcgtcccagccatggcgacatcctcggccgcgctgccccgaatactcggcgcgggtgcccgggccccgtcgcgctggttgggctttctcgggaaggcgaccccccggcctgctcggccgagccgcaggacgcttggaagcgcgacggcccttatgatccgcgagtcggaggacagcaccgatttcaacgacaagattttgaatgagcccctcaagcactctgacttcttcaatgtcaaggaactgttttccgtgagaagcctcttcgatgcccgagtccatctgggacacaaagctggctgtcggcacagagcaccccgctaagtccaaccccagaggggcctcatccgcaaagcctcgggaagaggacagtgacggaggcggctgccctgtgagctgcacggggcagaatgtccttttggcgtcatgttggatgtccacacatccatatggggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccgagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatgaga

SEQ ID NO: 373842 - DNA, 424 bp, Homo sapiens
gccccgcgcggatggcgacggaaggggaggccgctcggcctggcctggagggagacctcgctctgccccgcgtcccagccatggcgacatcctcggccgcgctgccccgaatactcggcgcgggtgcccgggccccgtcgcgctggttgggctttctcgggaaggcgaccccccggcctgctcggccgagccgcaggacgcttggaagcgcgacggcccttatgatccgcgagtcggaggacagcaccgatttcaacgacaagattttgaatgagcccctcaagcactctgacttcttcaatgtcaaggaactgttttccgtgagaagcctcttcgatgcccgagtccatctgggttggtgggacagccaggccagatgacctgattccagcaaaaataaaactcagatttgggcaaaatgaga

SEQ ID NO: 373843 - DNA, 217 bp, Homo sapiens
caaccccagaggggcctcatccgcaaagcctcgggaagaggacagtgacggaggcggctgccctgtgagctgcacggggcagaatgtccttttggcgtcatgttggatgtccacacatccatatggggtcagttctattaggattccttcgggaagaggtagagggtaggaggggttaagccacgagacgaggcatgcagaggggtggcctggatgg

SEQ ID NO: 373844 - DNA, 1807 bp, Homo sapiens
gccccgcgcggatggcgacggaaggggaggccgctcggcctggcctggagggagacctcgctctgccccgcgtcccagccatggcgacatcctcggccgcgctgccccgaatactcggcgcgggtgcccgggccccgtcgcgctggttgggctttctcgggaaggcgaccccccggcctgctcggccgagccgcaggacgcttggaagcgcgacggcccttatgatccgcgagtcggaggacagcaccgatttcaacgacaagattttgaatgagcccctcaagcactctgacttcttcaatgtcaaggaactgttttccgtgagaagcctcttcgatgcccgagtccatctgggacacaaagctggctgtcggcacaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccgagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatgagaaacacacaaaaaaaaggcaaaaaaaaacaccacacaaaaaaaaacacctttgggggcgccgggccctggaaaaagtttcagacccctcgtggggcgcgcggcccgtgtgtcgacctggccaagggtcccaggaaccggcgcagacagggcggttcccccaaaaaaaccggggccacgggtcttgaaaaccgaggttcgggcacgggtccaacggccggctacccccgcgcgcgatcgcagaaacaacaagacacagcgccgcgagcgagaaggcacgggcgaggccacgaagcgga

SEQ ID NO: 373845 - DNA, 1520 bp, Homo sapiens
gggactcggggagggcgcggggacgcggaggggacccgttagggacgcggaggggcccgttggggatgcggtggggagcgggcgtggtgcattcgggactcggcgccaggacctctatctacttccccccaggtgcccgggccccgtcgcgctggttgggctttctcgggaaggcgaccccccggcctgctcggccgagccgcaggacgcttggaagcgcgacggcccttatgatccgcgagtcggaggacagcaccgatttcaacgacaagattttgaatgagcccctcaagcactctgacttcttcaatgtcaaggaactgttttccgtgagaagcctcttcgatgcccgagtccatctgggacacaaagctggctgtcggcacaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccgagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatgaga

SEQ ID NO: 373846 - DNA, 1723 bp, Homo sapiens
gggactcggggagggcgcggggacgcggaggggacccgttagggacgcggaggggcccgttggggatgcggtggggagcgggcgtggtgcattcgggactcggcgccaggacctctatctacttccccccaggtgcccgggccccgtcgcgctggttgggctttctcgggaaggcgaccccccggcctgctcggccgagccgcaggacgcttggaagcgcgacggcccttatgatccgcgagtcggaggacagcaccggtaacactgggcgcccagccgagttgggtgggaacgaggagaggccggcagccgcgggggatgcgaaccctagaggggcctgggcgctgcacgcggtcgaaactgcgcgctccgctgggctcctcccactcccgtgctcgccgccgctcggtcctgcctgacgtagcacagcgggctgaggccaccgcctcaccatggataggatttcaacgacaagattttgaatgagcccctcaagcactctgacttcttcaatgtcaaggaactgttttccgtgagaagcctcttcgatgcccgagtccatctgggacacaaagctggctgtcggcacaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccgagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatgaga

SEQ ID NO: 373847 - DNA, 1714 bp, Homo sapiens
gccccgcgcggatggcgacggaaggggaggccgctcggcctggcctggagggagacctcgctctgccccgcgtcccagccatggcgacatcctcggccgcgctgccccgaatactcggcgcgggtgcccgggccccgtcgcgctggttgggctttctcgggaaggcgaccccccggcctgctcggccgagccgcaggacgcttggaagcgcgacggcccttatgatccgcgagtcggaggacagcaccggtaacactgggcgcccagccgagttgggtgggaacgaggagaggccggcagccgcgggggatgcgaaccctagaggggcctgggcgctgcacgcggtcgaaactgcgcgctccgctgggctcctcccactcccgtgctcgccgccgctcggtcctgcctgacgtagcacagcgggctgaggccaccgcctcaccatggataggatttcaacgacaagattttgaatgagcccctcaagcactctgacttcttcaatgtcaaggaactgttttccgtgagaagcctcttcgatgcccgagtccatctgggacacaaagctggctgtcggcacaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccgagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatgaga

SEQ ID NO: 373848 - DNA, 1196 bp, Homo sapiens
tggttactgagatggtgaaaaccaggggagacctgggggacatcacaagcttggttcctaccaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccgagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatgaga

SEQ ID NO: 373849 - DNA, 1081 bp, Homo sapiens
gccccgcgcggatggcgacggaaggggaggccgctcggcctggcctggagggagacctcgctctgccccgcgtcccagccatggcgacatcctcggccgcgctgccccgaatactcggcgcgggtgcccgggccccgtcgcgctggttgggctttctcgggaaggcgaccccccggcctgctcggccgagccgcaggacgcttggaagcgcgacggcccttatgatccgcgagtcggaggacagcaccgatttcaacgacaagattttgaatgagcccctcaagcactctgacttcttcaatgtcaaggaactgttttccgtgagaagcctcttcgatgcccgagtccatctgggacacaaagctggctgtcggcacaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgggttggtgggacagccaggccagatgacctgattccagcaaaaataaaactcagatttgggcaaaatgaga

SEQ ID NO: 373850 - DNA, 319 bp, Homo sapiens
ggttatgggatattacccttatagtcctagagcatttatactgctcgttaatcattgccttagaccttgaactgttcatttgttcaataaaatgtcttttttatcgggaatcaggaactaacaagtttatgttatgatatgattcacatgtaataaaccattataccaagagaagaaaaccagcccggatgttccaggaaaaactcacagcccacatgataggctaaataaattgcatgcattagttcatttctgacctggtactgttgagtgtgaactgcagttctcaattcccagttattcttaggaattaagacta

SEQ ID NO: 373851 - DNA, 620 bp, Homo sapiens
aattaatcccttcttcccccgctctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaaaaaaaaaaaaaaaaaaaacttcggagggcgttcatattgtcggggtgggggagaaaggagggtattggaacatgggcacttgggtcataaggctggtttcctggaccaagttttctgggtacaaagggggtagaattctggcggggtcttccctatagtggagtcggaataaattgggataaaggccaagggttaacctggctttaatactggggga

SEQ ID NO: 373852 - DNA, 703 bp, Homo sapiens
  misc_feature (133)..(133): n is a, c, g, or t
  misc_feature (141)..(141): n is a, c, g, or t
  misc_feature (332)..(332): n is a, c, g, or t
tggcctcagtatttcaaggattaaaggttctggcaattaaagtgactagttcatctgacacaagtatcccggccggttactgtctgagtagctcgtctgtttcggggtttaactttgctctcctgcaagttanttctagtnattcattatcaaaaggtataggggttagtccttgctatattatgcttggttataatttttcatctttcccatgcggtactatatctattgcgccaggtttcaatttctatcgcctatactttatctgggtaaatggtttggctaaggttgtctggtagtaaggtggagtgggtttctcgtgccgaattggnacgagcgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaa

SEQ ID NO: 373853 - DNA, 426 bp, Homo sapiens
aattcgcggccgcgtcgacacggctgcgagagacgacagaaggggtctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaa

SEQ ID NO: 373854 - DNA, 389 bp, Homo sapiens
gctggtacggtcggggttaggatcgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaa

SEQ ID NO: 373855 - DNA, 374 bp, Homo sapiens
gttggatccgaattcggatccaaccggaccaacgccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaa

SEQ ID NO: 373856 - DNA, 402 bp, Homo sapiens
gcctactactactaaattcgcggccgcgtcgacccctggccagcttgataggctgcacacggctggtgtcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaa

SEQ ID NO: 373857 - DNA, 469 bp, Homo sapiens
  misc_feature (123)..(123): n is a, c, g, or t
ctttagcacctgtctcgtccccagtggcttttccagaactactgccttcaccatgaagctccatgagctttcccaattcaaacttgggcttcttcagcatttttacttttctaacgcaagcanccttccgattcggcacgagatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaa

SEQ ID NO: 373858 - DNA, 870 bp, Homo sapiens
ggaaagttagatttacgccgatgaatatgatagtgaaatggattttggagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaatacatataactgtaaataataaatcaagaactgaagagctatatgtaaatgaccaagatcaacaggggaacataaaaagataataggggggggcatgatctataaactttaactggaaagaatgtttgatgtggcaagatattatattgacacgtggggaacacaattgaggactttgcatttcctgggtcaggcagggataatccaaagaatggtctaaggtcgggaagacttggctggtggaaggagagacccctaaggaaagtgtacggatattaagggcaggaagtagagaatgggatttggaaaattcccatgaccaaggttatgatatgaaccgatatggacatttaatctatactgaatagttcatgaatttgaatcacctgggtgatcatagggagagtggaaaagtatatacagagctattatgaagaaaattttaaggg

SEQ ID NO: 373859 - DNA, 358 bp, Homo sapiens
ccgcctctagagtatccccctatactgacctatctatactgacgcatctatactgacgctatctatactgacttatctatactgacctatctatactgacgtatctatactgacttatctatactgacccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaa

SEQ ID NO: 373860 - DNA, 442 bp, Homo sapiens
ctagaggatccccgtggtcgtactggagagaggggaaaagaggggggcctgctgcaatctccttgaggcaggaaacgtgggattcagccccagcctcacttagtggaggttcttttaccatggacccaggctgcctggtttgtatccaacctctgccccttctgacctggaagaggcgcttgaccttcctcccacatcccttccagtggggtgagtacaggtgttcctcagtttacaatgggttacattccggtgagtacatcataggttgaaagtattgcaagttgaaatgtgtttaatacacctaatctcccaaacatcacagcttagcatggtccatcttaagcttgttcagaacgccttagcctgtagttggggaaactcgtctaacacgaagcctgttttaataaagtattgaatgtcttatgtaatttattgaata

SEQ ID NO: 373861 - DNA, 414 bp, Homo sapiens
  misc_feature (1)..(1): n is a, c, g, or t
  misc_feature (6)..(7): n is a, c, g, or t
  misc_feature (20)..(21): n is a, c, g, or t
  misc_feature (24)..(24): n is a, c, g, or t
ngcatnntttagggaaccgnnttncgtaatgtctctccgacataccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaa

SEQ ID NO: 373862 - DNA, 544 bp, Homo sapiens
ggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccactcagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaa

SEQ ID NO: 373863 - DNA, 1335 bp, Homo sapiens
gctggtacggtcggggttaggatcgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaactcaggttcttgtctgggttatacgactagggtttctccaggtttcttgagtggctcccaggcggtcaccgatcctccgcactctggaaatcctggccgtgcggtcttgccaaacgaagcttttcctttttgaggcggggggtcgtgtttgtcgattgcaccctctaccccaaacaaaacacaagcgtagtaggaatgttttattagcaaagaagtttcagagagtgggtggatcagggctctatcacttggtccccacctcaccttggtggggccagagtgagccccttcctgccacagtcaccccaactgaaattgcctttctcttcggccagtgttagcctctgagcaggggaccctggacccttctgtgcgccaaaggctgaggtgactgacgaggagatctccccacagctaggtgtagtgagccagacgaggcagcttactgaacctgggggttctctccattgtcaccgcattctccttcaccaggtgtggctgtctgggagccagggggtgactcgctctggagagaggggaaaagaggggggcctgctgcaatctccttgaggcaggaaacgtgggattcagccccagcctcacttagtggaggttcttttaccatggacccaggctgcctggtttgtatccaacctctgccccttctgacctggaagaggcgcttgaccttcctcccacatcccttccagtggggtgagtacaggtgttcctcagtttacaatgggttacattccggtgagtacatcataggttgaaagtattgcaagttgaaatgtgtttaatacacctaatctcccaaacatcacagcttagcatggtccatcttaagcttgttcagaacgccttagcctgtagttggggaaactcgtctaacacgaagcctgttttaataaagtattgaatgtcttatgtaatttattgaata

SEQ ID NO: 373864 - DNA, 1051 bp, Homo sapiens
gctggtacggtcggggttaggatcgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaactcaggttcttgtctgggttatacgactagggtttctccaggtttcttgagtggctcccaggcggtcaccgatcctccgcactctggaaatcctggccgtgcggtcttgccaaacgaagcttttcctttttgaggcggggggtcgtgtttgtcgattgcaccctctaccccaaacaaaacacaagcgtagtaggaatgttttattagcaaagaagtttcagagagtgggtggatcagggctctatcacttggtccccacctcaccttggtggggccagagtgagccccttcctgccacagtcaccccaactgaaattgcctttctcttcggccagtgttagcctctgagcaggggaccctggacccttctgtgcgccaaaggctgaggtgactgacgaggagatctccccacagctaggtgtagtgagccagacgaggcagcttactgaacctgggggttctctccattgtcaccgcattctccttcaccaggtgtggctgtctgggagccagggggtgactcgctctgggtgtcgggctggcccagcttcaggtgggcatgtagcagagcggccacctcatcctgctcagcctccagggcgatggccagggcactggtgcttacattgtccaggatggcagggtcacagcctggctgggtg

SEQ ID NO: 373865 - DNA, 991 bp, Homo sapiens
aattcgcggccgcgtcgacacggctgcgagagacgacagaaggggtctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaacattttaaaaaataaatcaatctcttaacgatttcctatattttatttttcatccttattattttgactaacttggagaaatatgtccatttaagttacatttatcaaaacaaggagcctgtataaaacatatttacccatattaaaataattaattcacgcaataaatagcatccttaacataaaccatattttatgtaaactatttttattattcgtaggtgctataatattcctcattcctaaatatattctctcatttttaagacttattccaactttacttagcccctaataatctattttaaaaatgtactttctatcaattcatatcaatccttcattaattatagaataaaatgcttctatctttcttaaaaataatattgttaaaaatctaagagattcttctcttaaa

SEQ ID NO: 373866 - DNA, 612 bp, Homo sapiens
aattcgcggccgcgtcgacacggctgcgagagacgacagaaggggtctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaaaaaaaaaaaaaaaaaaaaaaaaaaaaaaaaaaaaaaaactctccggggggcttcttttatcgcgggggggcggaaaaaggggtgaagagagaagtggggccatggggtgacacaagggtggtccctgggacccacgtttttttgggtccaagggggcgacatctcgcggggtcccctattgggggg

SEQ ID NO: 373867 - DNA, 1584 bp, Homo sapiens
gctggtacggtcggggttaggatcgccgcgccgccatcatggacaccagccgtgtgcagcctatcaagctggccagggtcaccaaggtcctgggcaggaccggttctcagggacagtgcacgcaggtaatcgggtgggggcatttggccgactgccggcgacctaaaccctgatgtgacctctaccctgccctaacccctgccagccggaatccgggagccgattctcatttcatcacggggttctgatggttccctttaacgatctgtattctggccccgacacgttctctgaattcatatctgcttcccactccgcggtgcctttccgcggcccgcccttacttcttcctccactccggtggggacccgtaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaactcaggttcttgtctgggttatacgactagggtttctccaggtttcttgagtggctcccaggcggtcaccgatcctccgcactctggaaatcctggccgtgcggtcttgccaaacgaagcttttcctttttgaggcggggggtcgtgtttgtcgattgcaccctctaccccaaacaaaacacaagcgtagtaggaatgttttattagcaaagaagtttcagagagtgggtggatcagggctctatcacttggtccccacctcaccttggtggggccagagtgagccccttcctgccacagtcaccccaactgaaattgcctttctcttcggccagtgttagcctctgagcaggggaccctggacccttctgtgcgccaaaggctgaggtgactgacgaggagatctccccacagctaggtgtagtgagccagacgaggcagcttactgaacctgggggttctctccattgtcaccgcattctccttcaccaggtgtggctgtctgggagccagggggtgactcgctctggagagaggggaaaagaggggggcctgctgcaatctccttgaggcaggaaacgtgggattcagccccagcctcacttagtggaggttcttttaccatggacccaggctgcctggtttgtatccaacctctgccccttctgacctggaagaggcgcttgaccttcctcccacatcccttccagtggggtgagtacaggtgttcctcagtttacaatgggttacattccggtgagtacatcataggttgaaagtattgcaagttgaaatgtgtttaatacacctaatctcccaaacatcacagcttagcatggtccatcttaagcttgttcagaacgccttagcctgtagttggggaaactcgtctaacacgaagcctgttttaataaagtattgaatgtcttatgtaatttattgaata

SEQ ID NO: 373868 - DNA, 1670 bp, Homo sapiens
ggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccactcagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctggtgggtgcaaagaggacacccctttgatagacctttggttggtggtagggaggcttcgttaagcccagggtgagagggtttgggaggcagagtctacatacagagactgacaagagggaggcgggagtttgccaattgctgcggggcctgtcaacatctcatgtttgggtctgtttacagggtcttggatgtcgggttcgaccacttggccgatgggaatggtctgtcacaatctgctccttttttttgtccgccacacgtaactgagatgctcctttaaataaagcgtttgtgtttcaagttaactcaggttcttgtctgggttatacgactagggtttctccaggtttcttgagtggctcccaggcggtcaccgatcctccgcactctggaaatcctggccgtgcggtcttgccaaacgaagcttttcctttttgaggcggggggtcgtgtttgtcgattgcaccctctaccccaaacaaaacacaagcgtagtaggaatgttttattagcaaagaagtttcagagagtgggtggatcagggctctatcacttggtccccacctcaccttggtggggccagagtgagccccttcctgccacagtcaccccaactgaaattgcctttctcttcggccagtgttagcctctgagcaggggaccctggacccttctgtgcgccaaaggctgaggtgactgacgaggagatctccccacagctaggtgtagtgagccagacgaggcagcttactgaacctgggggttctctccattgtcaccgcattctccttcaccaggtgtggctgtctgggagccagggggtgactcgctctggagagaggggaaaagaggggggcctgctgcaatctccttgaggcaggaaacgtgggattcagccccagcctcacttagtggaggttcttttaccatggacccaggctgcctggtttgtatccaacctctgccccttctgacctggaagaggcgcttgaccttcctcccacatcccttccagtggggtgagtacaggtgttcctcagtttacaatgggttacattccggtgagtacatcataggttgaaagtattgcaagttgaaatgtgtttaatacacctaatctcccaaacatcacagcttagcatggtccatcttaagcttgttcagaacgccttagcctgtagttggggaaactcgtctaacacgaagcctgttttaataaagtattgaatgtcttatgtaatttattgaata

SEQ ID NO: 373869 - DNA, 566 bp, Homo sapiens
tgatcagaggcggggctttgctgttattattggaccatggcttgtatcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaaaaaaaaaaaaaaaaaaaaaaaaaaaaaaaaaaaaaaaactctccggggggcttcttttatcgcgggggggcggaaaaaggggtgaagagagaagtggggccatggggtgacacaagggtggtccctgggacccacgtttttttgggtccaagggggcgacatctcgcggggtcccctattgggggg

SEQ ID NO: 373870 - DNA, 885 bp, Homo sapiens
gcggccgcctactactactactactgctcgaattcaagcttctaacgatgtacggggagcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaacattttaaaaaataaatcaatctcttaacgatttcctatattttatttttcatccttattattttgactaacttggagaaatatgtccatttaagttacatttatcaaaacaaggagcctgtataaaacatatttacccatattaaaataattaattcacgcaataaatagcatccttaacataaaccatattttatgtaaactatttttattattcgtaggtgctataatattcctcattcctaaatatattctctcatttttaagacttattccaactttacttagcccctaataatctattttaaaaatgtactttctatcaattcatatcaatccttcattaattatagaataaaatgcttctatctttcttaaaaataatattgttaaaaatctaagagattcttctcttaaa

SEQ ID NO: 373871 - DNA, 1020 bp, Homo sapiens
gcctactactactaaattccccctcggtcgacacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaaaaaaaaaaaaaaaaaaaaaaaaaaaaaaaaaaaaaaaaaagaggcgagcaagaaaaaaaaaaaaaaaaagaagagaaaaagaagaaaaaaaagaagaaaaacaagcaaagaagagaacgacaaagaagagcgcagcgcacaacaagacagagcgagcgattatataaaacaacgggccgccgagccacggccgcgcggtcaacaagccacaacggtgataggaggaggacaaggcgaggacgcaagggggcgagccatccgtcgtgaagagaaggagacagacacatctccgcggcgcgcgaggtgagggaacgaaaaaaaataagcgagcgaagaacgcaacaagacaaccccgcagacagcgagaatgtagaaccgacacagacctacggagcgagaaaggaaacccacaaatcatcagaactgctataacagggacgtgtgagaaaatcactgaccgtgcgggggtgaccaccaccatgcgagccgtatcaggataataacagtgatggtcaagtgaggacgatgaaataatgaaggcagagatgtcgcgcacaagaccaacagagatacgacggggacagtgatcactgggaagaagcgagacacatggtatagatagctgccagcaccgagggacacgcgaggtgcgcacggtttagtacaatatggacaaaaaagagaaaggggaagtagcaagatgtaaaatacagcgggg

SEQ ID NO: 373872 - DNA, 403 bp, Homo sapiens
aattaatcccttcttcccccgctctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaa

SEQ ID NO: 373873 - DNA, 421 bp, Homo sapiens
ggaaagttagatttacgccgatgaatatgatagtgaaatggattttggagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaa

SEQ ID NO: 373874 - DNA, 848 bp, Homo sapiens
cccttaggtgattgacgtcagacacgggactctggtgcctgttgtcgtcctggaatcaagaaggagagaggaattggctgaggcatcagaaggaaagccactaggttctcgggctgctgaactggttcgattgtgacgtttctttctccctgctgttctgtcacaggggaccccactgtaatatcctcagggacgtgtcacccacagtcacaccacgttcttgctccccattccgcacatttctcgatggccgcccatcaccattcttgaagtcgtccttggcccggctgcgggtctccgcccaggaccggaccggcccgacatggcggcggcggggaacggcgggggccggggcactgctccccagacaccgggggtcgcgcgcctcacagcgcccgccaggcaccagcccagcaccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaaaaaaaaaaaatacatcgagacgagtctccctcggccgataacaccggccttgctacctagccgta

SEQ ID NO: 373875 - DNA, 361 bp, Homo sapiens
ttgcatatggcaaggccttgccatatgcaatgcatatggcaaggccaaggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaa

SEQ ID NO: 373876 - DNA, 656 bp, Homo sapiens
  misc_feature (515)..(516): n is a, c, g, or t
  misc_feature (518)..(518): n is a, c, g, or t
  misc_feature (527)..(527): n is a, c, g, or t
  misc_feature (529)..(530): n is a, c, g, or t
  misc_feature (539)..(539): n is a, c, g, or t
aattcgcggccgcgtcgacacggctgcgagagacgacagaaggggtctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaaaaaaaaaaaaaaaaaaaaaaaaaaaaaaaaaaaaaaaaaaaaaaaaaaaaaaaaaaaaaaaaagaaaaaaaaaaaaaaaaaaaaagcannanaaacaaaananngaaaaaaanaaaaaaaaaagacggaatcaaacaaagacgcccgagctaagagagcacgacacaaacaccagcaatacgcagacgaacgcaacacgcagcccgaaacagacagcggagggacaaaaa

SEQ ID NO: 373877 - DNA, 872 bp, Homo sapiens
  misc_feature (476)..(477): n is a, c, g, or t
  misc_feature (480)..(480): n is a, c, g, or t
  misc_feature (798)..(798): n is a, c, g, or t
aattcgcggccgcgtcgacacggctgcgagagacgacagaaggggtctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaaaaaaaaaaaaaaaaaaaaaaaaaaaaaaagctatagattctaccctaacnnctncttgcgaacgaattttgctttgtttggtccggtgtcaaatctggggcgtcctttataagtactctgtctggccgtttcaggcggctttctggaaaaggcgtgaaagccccaactttttgggatgccggagtaaccgcctttgattgctagaattatggtttgaatgccctaaagggttcctcttttataaaaattcaaggctgtaatgtcctatgaaattgaaacaatcactatttgtcaatataaccgggagattttgttaaaaaaggatttttttaaccaattggtgcttacgttttttcattattaagaaaaaantgggccgattcggttatattttttaaagagtggaaactagtcgcttttaacagggggcaccaaggcaatgggca

SEQ ID NO: 373878 - DNA, 1121 bp, Homo sapiens
aattaatcccttcttcccccgctctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaaaaaaaaaaaaaaaaaaaaaaaaaaaaaaaaaaaaaaaaaagaggcgagcaagaaaaaaaaaaaaaaaaagaagagaaaaagaagaaaaaaaagaagaaaaacaagcaaagaagagaacgacaaagaagagcgcagcgcacaacaagacagagcgagcgattatataaaacaacgggccgccgagccacggccgcgcggtcaacaagccacaacggtgataggaggaggacaaggcgaggacgcaagggggcgagccatccgtcgtgaagagaaggagacagacacatctccgcggcgcgcgaggtgagggaacgaaaaaaaataagcgagcgaagaacgcaacaagacaaccccgcagacagcgagaatgtagaaccgacacagacctacggagcgagaaaggaaacccacaaatcatcagaactgctataacagggacgtgtgagaaaatcactgaccgtgcgggggtgaccaccaccatgcgagccgtatcaggataataacagtgatggtcaagtgaggacgatgaaataatgaaggcagagatgtcgcgcacaagaccaacagagatacgacggggacagtgatcactgggaagaagcgagacacatggtatagatagctgccagcaccgagggacacgcgaggtgcgcacggtttagtacaatatggacaaaaaagagaaaggggaagtagcaagatgtaaaatacagcgggg

SEQ ID NO: 373879 - DNA, 313 bp, Homo sapiens
ggtgtcgtctagaggatccctcataggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaa

SEQ ID NO: 373880 - DNA, 638 bp, Homo sapiens
gctggtacggtcggggttaggatcgccgcgccgccatcatggacaccagccgtgtgcagcctatcaagctggccagggtcaccaaggtcctgggcaggaccggttctcagggacagtgcacgcaggtaatcgggtgggggcatttggccgactgccggcgacctaaaccctgatgtgacctctaccctgccctaacccctgccagccggaatccgggagccgattctcatttcatcacggggttctgatggttccctttaacgatctgtattctggccccgacacgttctctgaattcatatctgcttcccactccgcggtgcctttccgcggcccgcccttacttcttcctccactccggtggggacccgtaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaa

SEQ ID NO: 373881 - DNA, 1764 bp, Homo sapiens
gctggtacggtcggggttaggatcgccgcgccgccatcatggacaccagccgtgtgcagcctatcaagctggccagggtcaccaaggtcctgggcaggaccggttctcagggacagtgcacgcaggtaatcgggtgggggcatttggccgactgccggcgacctaaaccctgatgtgacctctaccctgccctaacccctgccagccggaatccgggagccgattctcatttcatcacggggttctgatggttccctttaacgatctgtattctggccccgacacgttctctgaattcatatctgcttcccactccgcggtgcctttccgcggcccgcccttacttcttcctccactccggtggggacccgtaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctggtgggtgcaaagaggacacccctttgatagacctttggttggtggtagggaggcttcgttaagcccagggtgagagggtttgggaggcagagtctacatacagagactgacaagagggaggcgggagtttgccaattgctgcggggcctgtcaacatctcatgtttgggtctgtttacagggtcttggatgtcgggttcgaccacttggccgatgggaatggtctgtcacaatctgctccttttttttgtccgccacacgtaactgagatgctcctttaaataaagcgtttgtgtttcaagttaactcaggttcttgtctgggttatacgactagggtttctccaggtttcttgagtggctcccaggcggtcaccgatcctccgcactctggaaatcctggccgtgcggtcttgccaaacgaagcttttcctttttgaggcggggggtcgtgtttgtcgattgcaccctctaccccaaacaaaacacaagcgtagtaggaatgttttattagcaaagaagtttcagagagtgggtggatcagggctctatcacttggtccccacctcaccttggtggggccagagtgagccccttcctgccacagtcaccccaactgaaattgcctttctcttcggccagtgttagcctctgagcaggggaccctggacccttctgtgcgccaaaggctgaggtgactgacgaggagatctccccacagctaggtgtagtgagccagacgaggcagcttactgaacctgggggttctctccattgtcaccgcattctccttcaccaggtgtggctgtctgggagccagggggtgactcgctctggagagaggggaaaagaggggggcctgctgcaatctccttgaggcaggaaacgtgggattcagccccagcctcacttagtggaggttcttttaccatggacccaggctgcctggtttgtatccaacctctgccccttctgacctggaagaggcgcttgaccttcctcccacatcccttccagtggggtgagtacaggtgttcctcagtttacaatgggttacattccggtgagtacatcataggttgaaagtattgcaagttgaaatgtgtttaatacacctaatctcccaaacatcacagcttagcatggtccatcttaagcttgttcagaacgccttagcctgtagttggggaaactcgtctaacacgaagcctgttttaataaagtattgaatgtcttatgtaatttattgaata

SEQ ID NO: 373882 - DNA, 251 bp, Homo sapiens
cacgagcagcaagtgtctggaaggtgttctagctgggtagagagcctattctaacagacacgcacatcgcagaaagcagcatgaacagctatcttccacatacttcccagtttacatttggtcttaatgatcttgaatagatcctctcttcattttactcagccaggttttgtactgatgtacaggtgttaaattacttcaagcatttttgtaagaggtgtatataattcaataaaaaaggtaaaacatga

SEQ ID NO: 373883 - DNA, 362 bp, Homo sapiens
ctaaaattggaacgatacagagaagattagcatggcccctgcgcaaggatgacgcaaattcgtgaagcgttccatattttttgagcagaaaggagttggggcttgatgaaggcgtggatagcctgaaggcagccattcaggtaaacttggcagtttgttgccacatctttaatgatctgattcctactgctaatattttctttggaatgttgtattttgttttcttcttttaagacataaccgcataccttctatttgtccttttaaagtgtacaatttggtggttttaagtgtatttacaaagttttacaattattaacaccaattgtaggacattttcaccattccaaaaaaactccata

SEQ ID NO: 373884 - DNA, 1434 bp, Homo sapiens
ggcgcgaaaaagaagcagtcctgggttgtacccggcgcagctgggagcggctgcttcctccggggtcgtatctccgcccggcatggggctgctggacctttgcgaggaagtgttcggcaccgccgacctttaccgggtgctgggcgtgcgacgcgaggcctccgacggcgaggtccgacgaggctaccacaaggtgtccctgcaggtacacccggaccgggtgggtgagggcgacaaggaggacgccacccgccgcttccagatcctgggaaaagtctattccgttctcagtgacagagaacagagagcagtgtacgatgagcagggaacagtggacgaggactctcctgtgctcacccaagaccgagactgggaggcgtattggcggctactctttaaaaagatatctttagaggacattcaagcttttgaaaagacatacaaaggttcggaagaagagctggctgatattaagcaggcctatctggacttcaagggtgacatggatcagatcatggagtctgtgctttgcgtgcagtacacagaggaacccaggataaggaatatcattcagcaagctattgacgccggagaggtcccatcctataatgcctttgtcaaagaatcgaaacaaaagatgaatgcaaggaaaaggagggctcaggaagaggccaaagaagcagaaatgagcagaaaggagttggggcttgatgaaggcgtggatagcctgaaggcagccattcagagcagacaaaaggatcggcaaaaggaaatggacaattttctggctcagatggaagcaaagtactgcaaatcttccaaaggaggagggaaaaaatctgctctcaagaaagaaaagaaataatggaatttttctcttcaaaggtccttaggtgtaaattgatgccatcgtaggcaaggtgcaggcaggatttgaaggcaaaagtcaattcagctcttgagaaaaggtgtctttccagcctgaatttttcagattgactagaccaagcagaatctctcaacctgatcttagtatttcctagaaagcacttgacattgtgtgaggtctcacctgaaggaacttggtggtgacatttgggagggtggagggaggcagtgtccttcctgacagcacttgcctccatggatcttctgtacacagaactcttatctaggatgtggttctgttcatgctgctttctgcgatgtgcgtgtctgttagaataggctctctacccagctagaacaccttccagacacttgctggacagctatcttccacatacttcccagtttacatttggtcttaatgatcttgaatagatcctctcttcattttactcagccaggttttgtactgatgtacaggtgttaaattacttcaagcatttttgtaagaggtgtatataattcaataaaaaaggtaaaacatga

SEQ ID NO: 373885 - DNA, 813 bp, Homo sapiens
ctaaggatccccgacgatggttgcaaggaaaaggagggctcaggaagaggccaaagaagcagaaatgagcagaaaggagttggggcttgatgaaggcgtggatagcctgaaggcagccattcagagcagacaaaaggatcggcaaaaggaaatggacaattttctggctcagatggaagcaaagtactgcaaatcttccaaaggaggagggaaaaaatctgctctcaagaaagaaaagaaataatggaatttttctcttcaaaggtccttaggtgtaaattgatgccatcgtaggcaaggtgcaggcaggatttgaaggcaaaagtcaattcagctcttgagaaaaggtgtctttccagcctgaatttttcagattgactagaccaagcagaatctctcaacctgatcttagtatttcctagaaagcacttgacattgtgtgaggtctcacctgaaggaacttggtggtgacatttgggagggtggagggaggcagtgtccttcctgacagcacttgcctccatggatcttctgtacacagaactcttatctaggatgtggttctgttcatgctgctttctgcgatgtgcgtgtctgttagaataggctctctacccagctagaacaccttccagacacttgctggacagctatcttccacatacttcccagtttacatttggtcttaatgatcttgaatagatcctctcttcattttactcagccaggttttgtactgatgtacaggtgttaaattacttcaagcatttttgtaagaggtgtatataattcaataaaaaaggtaaaacatga

SEQ ID NO: 373886 - DNA, 1380 bp, Homo sapiens
ggcgcgaaaaagaagcagtcctgggttgtacccggcgcagctgggagcggctgcttcctccggggtcgtatctccgcccggcatggggctgctggacctttgcgaggaagtgttcggcaccgccgacctttaccgggtgctgggcgtgcgacgcgaggcctccgacggcgaggtccgacgaggctaccacaaggtgtccctgcaggtacacccggaccgggtgggtgagggcgacaaggaggacgccacccgccgcttccagatcctgggaaaagtctattccgttctcagtgacagagaacagagagcagtgtacgatgagcagggaacagtggacgaggactctcctgtgctcacccaagaccgagactgggaggcgtattggcggctactctttaaaaagatatctttagaggacattcaagcttttgaaaagacatacaaaggttcggaagaagagctggctgatattaagcaggcctatctggacttcaagggtgacatggatcagatcatggagtctgtgctttgcgtgcagtacacagaggaacccaggataaggaatatcattcagcaagctattgacgccggagaggtcccatcctataatgcctttgtcaaagaatcgaaacaaaagatgaatgcaaggaaaaggagggctcaggaagaggccaaagaagcagaaatgagcagaaaggagttggggcttgatgaaggcgtggatagcctgaaggcagccattcagagcagacaaaaggatcggcaaaaggaaatggacaattttctggctcagatggaagcaaagtactgcaaatcttccaaaggaggagggaaaaaatctgctctcaagaaagaaaagaaataatggaatttttctcttcaaaggtccttaggtgtaaattgatgccatcgtaggcaaggtgcaggcaggatttgaaggcaaaagtcaattcagctcttgagctcaacctgatcttagtatttcctagaaagcacttgacattgtgtgaggtctcacctgaaggaacttggtggtgacatttgggagggtggagggaggcagtgtccttcctgacagcacttgcctccatggatcttctgtacacagaactcttatctaggatgtggttctgttcatgctgctttctgcgatgtgcgtgtctgttagaataggctctctacccagctagaacaccttccagacacttgctggacagctatcttccacatacttcccagtttacatttggtcttaatgatcttgaatagatcctctcttcattttactcagccaggttttgtactgatgtacaggtgttaaattacttcaagcatttttgtaagaggtgtatataattcaataaaaaaggtaaaacatga

SEQ ID NO: 373887 - DNA, 329 bp, Homo sapiens
cgaaaaagaagcagtcctgggttgtacccggcgcagctgggagcggctgcttcctccggggtcgtatctccgcccggcatggggctgctggacctttgcgaggaagtgttcggcaccgccgacctttaccgggtgctgggcgtgcgacgcgaggcctccgacggcgaggtccgacgaggctaccacaaggtgtccctgcaggtacacccggaccgggtgggtgagggcgacaaggaggacgccacccgccgcttccaggtatgcagggtcccgccccgaagccgaccggctgcgcgggcctccccctagccttttggctaccgggcccc

SEQ ID NO: 373888 - DNA, 1580 bp, Homo sapiens
ggcgcgaaaaagaagcagtcctgggttgtacccggcgcagctgggagcggctgcttcctccggggtcgtatctccgcccggcatggggctgctggacctttgcgaggaagtgttcggcaccgccgacctttaccgggtgctgggcgtgcgacgcgaggcctccgacggcgaggtccgacgaggctaccacaaggtgtccctgcaggtacacccggaccgggtgggtgagggcgacaaggaggacgccacccgccgcttccagatcctgggaaaagtctattccgttctcagtgacagagaacagagagcagtgtacgatgagcagggaacagtggacgaggactctcctgtgctcacccaagaccgagactgggaggcgtattggcggctactctttaaaaagatatctttagaggacattcaagcttttgaaaagacatacaaaggttcggaagaagagctggctgatattaagcaggcctatctggacttcaagggtgacatggatcagatcatggagtctgtgctttgcgtgcagtacacagaggaacccaggataaggaatatcattcagcaagctattgacgccggagaggtcccatcctataatgcctttgtcaaagaatcgaaacaaaagatgaatgcaaggaaaaggagggctcaggaagaggccaaagaagcagaaatgagcagaaaggagttggggcttgatgaaggcgtggatagcctgaaggcagccattcagagcagacaaaaggatcggcaaaaggaaatggacaattttctggctcagatggaagcaaagtactgcaaatcttccaaaggaggagggaaaaaatctgctctcaagaaagaaaagaaataatggaatttttctcttcaaaggtccttaggtgtaaattgatgccatcgtaggcaaggtgcaggcaggatttgaaggcaaaagtcaattcagctcttgagaaaaggtgtctttccagcctgaatttttcagattgactagaccaagcagaatctctcaacctgatcttagtatttcctagaaagcacttgacattgtgtgaggtctcacctgaaggaacttggtggtgacatttgggagggtggagggaggcagtgtccttcctgacagcacttgcctccatggatcttctgtacacagaactcttatctaggatgtggttctgttcatgctgctttctgcgatgtgcgtgtctgttagaataggctctctacccagctagaacaccttccagacacttgctggacagctatcttccacatacttcccagtttacatttggtcttaatgatcttgaatagatcctctcttcattttactcagccaggttttgtactgatgtacaggtgttaaattacttcaagcatttttgtaagaggtgtatataattcaataaaaaaggtaaaacatgatgattaagttctgggggctttgtaaatgatcccactaaaatgtgacctaggaaaaatatgaatggtgtttaggatgagagaaaagggaaaacaatagccctggtcagctttataatagagagcctggtttccctagcatgaagaga

SEQ ID NO: 373889 - DNA, 960 bp, Homo sapiens
ggcgcgaaaaagaagcagtcctgggttgtacccggcgcagctgggagcggctgcttcctccggggtcgtatctccgcccggcatggggctgctggacctttgcgaggaagtgttcggcaccgccgacctttaccgggtgctgggcgtgcgacgcgaggcctccgacggcgaggtccgacgaggctaccacaaggtgtccctgcaggtacacccggaccgggtgggtgagggcgacaaggaggacgccacccgccgcttccagatcctgggaaaagtctattccgttctcagtgacagagaacagagagcagtgtacgatgagcagggaacagtggacgaggactctcctgtgctcacccaagaccgagactgggaggcgtattggcggctactctttaaaaagatatctttagaggacattcaagcttttgaaaagacatacaaaggttcggaagaagagctggctgatattaagcaggcctatctggacttcaagggtgacatggatcagatcatggagtctgtgctttgcgtgcagtacacagaggaacccaggataaggaatatcattcagcaagctattgacgccggagaggtcccatcctataatgcctttgtcaaagaatcgaaacaaaagatgaatgcaaggaaaaggagggctcaggaagaggccaaagaagcagaaatgagcagaaaggagttggggcttgatgaaggcgtggatagcctgaaggcagccattcaggttttagcatcaagactctgctgaccttattatgaactgaattgagaagtattccttatactttttggaaaaaagtttgcatcattgttatttcttccacaaatggatgagagaattcacctgggcctagagctttctctgtgtgagaactgtttcatttaatttcttgaataattttacaataatccacaaatataataaccttataaaagtat

SEQ ID NO: 373890 - DNA, 295 bp, Homo sapiens
atttttgaattttttagagatgaggtttcactatattggccaggctggtctcaaactcctagcctcaagtgatccacccgccttggcctcccaaagtactgggattacaggcgtgagccagccaaggcaatgattttcaacccagagaaatctggcccctcagggggacatttgacaacctctagagacttttttgattgttacaattgggaagaggggtgctcttggtatctagtgggtaagaggccagtgatgctgctaaaaatcctacaatgcgtagaacagcacctgcagc

SEQ ID NO: 373891 - DNA, 465 bp, Homo sapiens
gtgagaattagacaaggacactaaaagaattattataactgtattccatatgtactaagtagagactaggaagatatttttaaatacccactttgaattttagagacgaaaactaaaatgtctgagatgatggggtgggtggggtaggcagaaagaggaggatgggaagaagtaccaaggggaaggaggaatgatttggggatgacggctgtgtttattatcttaattgtggtgatggtttcacaggtatatgtaatttctaaacttatcaaattgtacacttaaaatatgtggtctatggaatgttaattatatctcaataaagctgttaaaattgtactgaaacaaaaccattgggggaaactgggtaaagagtccaaaggacctccctatactatcattgtaacttcctgtcaattataacgattccaaaataaagaatttaaaagtgtttttaaaattaaa

SEQ ID NO: 373892 - DNA, 399 bp, Homo sapiens
tttttcatatatgtttactgggtgtttcagtaaatcagccaccaaattttccctgaagcagtcatccactcaattattactgaatgcctaataactaaccatgtattgaatgcttactatatgcaaggaacattacatattttatctctaatcctctcagcaactccacaagctagggattattatattcatttcagagatgcgtctgaggcccaaagaataattacccaagttttcacagctggtaaatggaagaatcagactttgaacttaggcttatttactccaaagtccattacccattcattataccccatggcacacacaagtctatgactcaaaatccagacacataaaaagctgaataatttaaaaggttttgctacttgactcagtaca

SEQ ID NO: 373893 - DNA, 1702 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373894 - DNA, 1045 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccaggtcctgacttccagtccttgttctcaccacagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgaggtgaaagtcccttaacttccaacctgaactttttgaccatcagttccctattcataaagtagttttctaggatggggattcttgggacattgcatatgcattttttttttaaagaggatctccgctggacatagtgggctcctgcctgcagtcccaactgtttgggaggctgaggcaggaggattgcttgagccagtttgaggctgcagtgagctgtgatctccactgtactccagcctggtgacagagtgagacctcatctcttaa

SEQ ID NO: 373895 - DNA, 1992 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtgagttaaaattccttgttctccttaagtcttgaagcagcttcatggatttcatgcctttgctcctctcattgtctttattcttcaccatttttctccttcatgggtttctttatccctctttgagggtctccatcctgattatgtaatgcctatttctttttaggactccttctccctctatgattgctcttacacagctactgacatttatactttcgtgtaattcaagtcttctgcatattttccccttttgtgaacaggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373896 - DNA, 1751 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcaggtatggggggtgtgaccaaaatcagtgggatgtggcaggaagctgcagcccacgccagcatctgtttccacagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373897 - DNA, 1881 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggtgagtgcctacattccctgctgtcggagagactctggatctgcagagacatctccgcgcagaggaggagcgctcctggcagcccccgccctagcgattgccagcaactttcctttctgccaggaaatcaacctacctttctctgcctgcaggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373898 - DNA, 1961 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggtgagtgcctacattccctgctgtcggagagactctggatctgcagagacatctccgcgcagaggaggagcgctcctggcagcccccgccctagcgattgccagcaactttcctttctgccaggaaatcaacctacctttctctgcctgcaggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttggtgagtaacggcgggaaagcgagaagaaacgggactggacctacatgcaagtgattccgcttttcgtctttggcccatagggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373899 - DNA, 1252 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcaggtatggggggtgtgaccaaaatcagtgggatgtggcaggaagctgcagcccacgccagcatctgtttccacagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373900 - DNA, 1426 bp, Homo sapiens
cgcccaccttggcctcccaaagtgctgggattacaagcatgagccactgtgcccagctgagtctacctttttttttttaggagttgtaaataaaacaagaaaataacactattagttattttattactaactatacaactactttaacataacactctcttttcccaggggtggggttgggtgtaaatgggcctcttgtagagatgactcttggtcatgggaattggtgatttataataattttgccatcttagggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtgagttaaaattccttgttctccttaagtcttgaagcagcttcatggatttcatgcctttgctcctctcattgtctttattcttcaccatttttctccttcatgggtttctttatccctctttgagggtctccatcctgattatgtaatgcctatttctttttaggactccttctccctctatgattgctcttacacagctactgacatttatactttcgtgtaattcaagtcttctgcatattttccccttttgtgaacaggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373901 - DNA, 1063 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcaggtatggggggtgtgaccaaaatcagtgggatgtggcaggaagctgcagcccacgccagcatctgtttccacagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373902 - DNA, 916 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaagg

SEQ ID NO: 373903 - DNA, 810 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373904 - DNA, 286 bp, Homo sapiens
tctgcatattttccccttttgtgaacaggtactggtggagaatggaacaaaagctgggcacagccttctcatggatgccagggatctggtccttaaggtaaggcttcttcttccctcactcccccacccatatggcaccaattactgttactctcttgaaaacgaaagagactgtcatgtattgacaagggtggctctcaggaaactgggcgtatgaagtcattatgatacagagcagtggttggcaaatgagagcctgtggatcaaatccgacctgccacctgtt

SEQ ID NO: 373905 - DNA, 809 bp, Homo sapiens
ggctgctcacagtatttggggccagagcctacgtgaatatatgtgtgtggacagatcagctgccatgttggttttggcagaaaaactactgaaaggtgagtgcaagagcacttccaaagttgagggagttaagaaagcaaaggggtactagtaaaagtgttttactgggaagtagagaagagggtaaaaattaagatgaatctggtttacttttaaagttatagtcaagcaaagggtggtattagaggtttctgctggactgaggatgggttgggtaagaatcaaaggacaggaggcctaatattctccctgcccttttttttttttttttaattagaggtagggtctccatatgttacccaggctggtctcaaactcctggcctcaagccatcctcccacttcagcctctagggtagctgggattacaggcacgcaccgccatacctggctcatccctgccctttttgatatacactttacctattcttggggccatgtttcttatctggatatctcttcagtttatacctaacttcctacacactcacagttgcctcttcttttctccacaggtggttcagaatctggggagccttatattccaggtgtctttttcagacagtttctacctgtatcacccaaggcaagtggcagtgtttagaatattctaaatgtggaatgtggcagatggaaaactatggcttgagctttgcagcccagcactgagtgttagaagataaaagaaatttagcggctaggactttgttgtattcttgggatgtagagatgttgagtctgtcatgttcc

SEQ ID NO: 373906 - DNA, 1729 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373907 - DNA, 1802 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcaggtatggggggtgtgaccaaaatcagtgggatgtggcaggaagctgcagcccacgccagcatctgtttccacagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373908 - DNA, 2323 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtgagttaaaattccttgttctccttaagtcttgaagcagcttcatggatttcatgcctttgctcctctcattgtctttattcttcaccatttttctccttcatgggtttctttatccctctttgagggtctccatcctgattatgtaatgcctatttctttttaggactccttctccctctatgattgctcttacacagctactgacatttatactttcgtgtaattcaagtcttctgcatattttccccttttgtgaacaggtactggtggagaatggaacaaaagctgggcacagccttctcatggatgccagggatctggtccttaagggaaaagagaagtcacctttggaccctcgacctggttttgtctttgccccggtgagtattacttctgcctgtcccaccacacggatctgaacttaggcgtggccgggaaatgtaagatggtaaagctaagccactctccactactttgtgttcctatccagttcctacctaatgattcccctggctcttcctacccactgctcctgtcctcccttctccctggccccttttgactctattattctcagtttttaagttttgtgattgatggctcttttgtcttacctcatttttttatgtgttcacagttgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcaggtatggggggtgtgaccaaaatcagtgggatgtggcaggaagctgcagcccacgccagcatctgtttccacagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373909 - DNA, 2060 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccggtgagtattacttctgcctgtcccaccacacggatctgaacttaggcgtggccgggaaatgtaagatggtaaagctaagccactctccactactttgtgttcctatccagttcctacctaatgattcccctggctcttcctacccactgctcctgtcctcccttctccctggccccttttgactctattattctcagtttttaagttttgtgattgatggctcttttgtcttacctcatttttttatgtgttcacagttgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcaggtatggggggtgtgaccaaaatcagtgggatgtggcaggaagctgcagcccacgccagcatctgtttccacagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373910 - DNA, 1761 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccaggtcctgacttccagtccttgttctcaccacagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373911 - DNA, 1809 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttggtgagtaacggcgggaaagcgagaagaaacgggactggacctacatgcaagtgattccgcttttcgtctttggcccatagggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373912 - DNA, 1190 bp, Homo sapiens
ggaagcttgtgtgcgtgtagggggagtctatagaatacccgagcgagagagaacgaagatgatctgagtgtagcaaggctaaatgcactaagctgaattacagtacacattagtcagggactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373913 - DNA, 872 bp, Homo sapiens
ggctggtctggtccggaaggtccttaggatgacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcaggtatggggggtgtgaccaaaatcagtgggatgtggcaggaagctgcagcccacgccagcatctgtttccacagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 373914 - DNA, 1013 bp, Homo sapiens
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgaggtgaaagtcccttaacttccaacctgaactttttgaccatcagttccctattcataaagtagttttctaggatggggattcttgggacattgcatatgcattttttttttaaagaggatctccgctggacatagtgggctcctgcctgcagtcccaactgtttgggaggctgaggcaggaggattgcttgagccagtttgaggctgcagtgagctgtgatctccactgtactccagcctggtgacagagtgagacctcatctcttaa

SEQ ID NO: 373915 - DNA, 538 bp, Homo sapiens
  misc_feature (489)..(489): n is a, c, g, or t
  misc_feature (496)..(496): n is a, c, g, or t
gccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgcgagcgctgggcccgctgtggccaatcaggcgcttgcgctgnccagggntgggtggggcgggcctccggctggggagcctgatggggcctt

SEQ ID NO: 373916 - DNA, 581 bp, Homo sapiens
atgggccacaacccgctctagcttgaaggcaccaccgcaaaggtcagccagagggggatacagggaacacccctatggtagatattgaaggtccttcccacctgtgacctcacctcaaagacaattcatagcctgtggtctccacataaacagcaacaagacaagtaatagtcctttttttgtttgtttgtttctattctagggataactgctcatgattactcccatatatttctagtatttccctctgtactgttggcgtgacattgacactagtattattttacaaaacagactgaaaaagacattagcaagcatagtctataaacctttcagtaggatgatattctcttggttgtttttcattgttgtgtgtaatcttttttttttctttttctttttttttttttgtgaggaaaaggcatgaatttgttaacagattttgagtctcaaccaactagcagaaactttgtttagggttggctaaaagctgttaatagagatttgtggaacctgataataaagttgtagataagatgttttaacctgtcttttaatatctgttagttagacaaagatgt

SEQ ID NO: 373917 - DNA, 675 bp, Homo sapiens
atgggccacaacccgctctagcttgaaggcaccaccgcaaaggtcagccagagggggatacagggaacacccctatggtagatattgaaggtccttcccacctgtgacctcacctcaaagacaattcatagcctgtggtctccacataaacagcaacaagacaagtacccacaaacaaagaacacataattgaataaccgatgtgatttgctaagaaggatggaggtgaagatgtatgatagaaaaacgaaaaactggaataaacccaagactggctgtttggaggtttaatgtttttaacaatggaggccaaaaaagaagataatttggatttgaaccaatattttcttcatctcaactcacctcaccactacggatccaagcctgacacagagcctaacagaaatactttcctccaaatacaatcctgttcaccatggaagacattaaaaccttcagtggttgctgctgggggccttcaccaaaatgcagccattcaccttgctgctgggggccttcaccaaaatgcagccattcacctttgcttttgctctacctacaaaaaatgttcattggctcactcccgaggtcaactttgattcaaagatagtcttcagttaccaaaccttatcacatgactgtaaaactagataataaacaagtgtttaaaatatg

SEQ ID NO: 373918 - DNA, 4060 bp, Homo sapiens
ggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttcccccc

SEQ ID NO: 373919 - DNA, 6979 bp, Homo sapiens
ggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagccagggctgagcagtgggccatctgtcgctggaaaaatgtctcttccttcctaggcctacctctgttggtgcttttgtcttccaacctccctatgtagtaagaccagccaagcccacatgcccactgggagccctgaaaccagatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaaaaagaaaagaaaagaaagaaaactcagctaggaattagaaacatcatttgtcctcttggcctgttcagctggtgactgtagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagcaccactatgtcctgtgctggtctccacagccccgaagtctcagctcaggaagggtgagtgctgggggattatcagctggggctcggctccctcccttgcagacagcaagcaggtaagggcttcattttgctgttttctccatggagggctctgggaaaggatcctgcaagttggaacctcctaagactccagaaccaggagcggctccctctcatatctactcccctcaaaccctgtcattcccgggaagctcccagaggcagctgaggccacgcccctgctcctgagcggcagcatccagacccggaaaggacctagtttcagcctggcacctcccaaggtgagccatctcttcttaggcatagtaggaacatggagaccacactacccccactccctgaaagctgggatgggatggtgagtcaagggtcaccatgcccctattagtctggctggagttaggttaggcatcctcccagggctcattgaccccagggggaacttggggaggcaagggactgaccagctggcctcccagggtgcctctggccaggccatgctggatctggctctgggtcaagcgctgctggtttgaagagctgccagcctgtggcgccttccctgacaggcactctcatcagcaaaggcatccctggttctgccttcccttcctctttgcttcaaaggcaccatccgtctccctggcaggccaagagctacact

SEQ ID NO: 373920 - DNA, 7138 bp, Homo sapiens
ggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagccagggctgagcagtgggccatctgtcgctggaaaaatgtctcttccttcctaggcctacctctgttggtgcttttgtcttccaacctccctatgtagtaagaccagccaagcccacatgcccactgggagccctgaaaccagatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaaaaagaaaagaaaagaaagaaaactcagctaggaattagaaacatcatttgtcctcttggcctgttcagctggtgactgtagtcccagatgtctatggattcctgcgggtcacctctccttttcctgctgccatgcctcctcctcccctggtcactaccacaccactgaaaatgagggggtcttggcggtgcgaagctacacttctagccacgatcttgtggggactggctgggatgaaaaatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagcaccactatgtcctgtgctggtctccacagccccgaagtctcagctcaggaagggtgagtgctgggggattatcagctggggctcggctccctcccttgcagacagcaagcaggtaagggcttcattttgctgttttctccatggagggctctgggaaaggatcctgcaagttggaacctcctaagactccagaaccaggagcggctccctctcatatctactcccctcaaaccctgtcattcccgggaagctcccagaggcagctgaggccacgcccctgctcctgagcggcagcatccagacccggaaaggacctagtttcagcctggcacctcccaaggtgagccatctcttcttaggcatagtaggaacatggagaccacactacccccactccctgaaagctgggatgggatggtgagtcaagggtcaccatgcccctattagtctggctggagttaggttaggcatcctcccagggctcattgaccccagggggaacttggggaggcaagggactgaccagctggcctcccagggtgcctctggccaggccatgctggatctggctctgggtcaagcgctgctggtttgaagagctgccagcctgtggcgccttccctgacaggcactctcatcagcaaaggcatccctggttctgccttcccttcctctttgcttcaaaggcaccatccgtctccctggcaggccaagagctacact

SEQ ID NO: 373921 - DNA, 7121 bp, Homo sapiens
ggccgacgtccctcgtgggcggcccctcctcccgcctgttgtcagatggcgtccggccgcggttaaggtggagaggagctgtggacgggcagggccctttcctggccctgggggtgcagagaaattgtggggtcggccaagtcagcaccccggcgggtcgggaaggggtagtagctcggacctaggcgagtgcccaaattctcagcgggcgaggcgggtcggctctgggaggtttatggccgaagtactggacgcaccgatcttccccagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagccagggctgagcagtgggccatctgtcgctggaaaaatgtctcttccttcctaggcctacctctgttggtgcttttgtcttccaacctccctatgtagtaagaccagccaagcccacatgcccactgggagccctgaaaccagatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaaaaagaaaagaaaagaaagaaaactcagctaggaattagaaacatcatttgtcctcttggcctgttcagctggtgactgtagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagcaccactatgtcctgtgctggtctccacagccccgaagtctcagctcaggaagggtgagtgctgggggattatcagctggggctcggctccctcccttgcagacagcaagcaggtaagggcttcattttgctgttttctccatggagggctctgggaaaggatcctgcaagttggaacctcctaagactccagaaccaggagcggctccctctcatatctactcccctcaaaccctgtcattcccgggaagctcccagaggcagctgaggccacgcccctgctcctgagcggcagcatccagacccggaaaggacctagtttcagcctggcacctcccaaggtgagccatctcttcttaggcatagtaggaacatggagaccacactacccccactccctgaaagctgggatgggatggtgagtcaagggtcaccatgcccctattagtctggctggagttaggttaggcatcctcccagggctcattgaccccagggggaacttggggaggcaagggactgaccagctggcctcccagggtgcctctggccaggccatgctggatctggctctgggtcaagcgctgctggtttgaagagctgccagcctgtggcgccttccctgacaggcactctcatcagcaaaggcatccctggttctgccttcccttcctctttgcttcaaaggcaccatccgtctccctggcaggccaagagctacact

SEQ ID NO: 373922 - DNA, 6590 bp, Homo sapiens
ggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagccagggctgagcagtgggccatctgtcgctggaaaaatgtctcttccttcctaggcctacctctgttggtgcttttgtcttccaacctccctatgtagtaagaccagccaagcccacatgcccactgggagccctgaaaccagatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaaaaagaaaagaaaagaaagaaaactcagctaggaattagaaacatcatttgtcctcttggcctgttcagctggtgactgtagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagcaccactatgtcctgtgctggtctccacagccccgaagtctcagctcaggaagggtgagtgctgggggattatcagctggggctcggctccctcccttgcagacagcaagcaggtaagggcttcattttgctgttttctccatggagggctctgggaaaggatcctgcaagttggaacctcctaagatccccaagcaccagcgattcgaatacctcgcacatctccaagctcaatcctgcagtccactgtagaggatagaccaccctaatagccacgacacgctgcctcctcgtccaaaccactcacacctcctgtaaacactaagtgacacgcg
